US009914907B2

(12) United States Patent
Roberts et al.

(10) Patent No.: US 9,914,907 B2
(45) Date of Patent: Mar. 13, 2018

(54) CYANOBACTERIA HAVING IMPROVED PHOTOSYNTHETIC ACTIVITY

(71) Applicant: Lumen Bioscience, Inc., Seattle, WA (US)

(72) Inventors: James Roberts, Seattle, WA (US); Michael Carleton, Kirkland, WA (US); Damian Carrieri, Seattle, WA (US); Jason W. Hickman, San Diego, CA (US)

(73) Assignee: LUMEN BIOSCIENCE, INC., Seattle, WA (US)

( * ) Notice: Subject to any disclaimer, the term of this patent is extended or adjusted under 35 U.S.C. 154(b) by 0 days.

(21) Appl. No.: 14/775,606

(22) PCT Filed: Mar. 10, 2014

(86) PCT No.: PCT/US2014/022842
§ 371 (c)(1),
(2) Date: Sep. 11, 2015

(87) PCT Pub. No.: WO2014/164566
PCT Pub. Date: Oct. 9, 2014

(65) Prior Publication Data
US 2016/0046902 A1    Feb. 18, 2016

Related U.S. Application Data

(60) Provisional application No. 61/780,755, filed on Mar. 13, 2013.

(51) Int. Cl.
| | | |
|---|---|---|
| *C07K 14/05* | (2006.01) | |
| *C12P 7/64* | (2006.01) | |
| *C12N 1/20* | (2006.01) | |
| *C07K 14/195* | (2006.01) | |
| *C12R 1/89* | (2006.01) | |

(52) U.S. Cl.
CPC .............. *C12N 1/20* (2013.01); *C07K 14/195* (2013.01); *C12P 7/64* (2013.01); *C12P 7/6409* (2013.01); *C12P 7/649* (2013.01); *C12P 7/6436* (2013.01); *C12R 1/89* (2013.01); *Y02E 50/13* (2013.01)

(58) Field of Classification Search
None
See application file for complete search history.

(56) References Cited

FOREIGN PATENT DOCUMENTS

| WO | WO2010075440 | 7/2010 |
| WO | WO2013116517 | 8/2013 |
| WO | WO2014164566 | 10/2014 |

OTHER PUBLICATIONS

Karradt et al (The Journal of biological chemistry, (Nov. 21, 2008) vol. 283, No. 47, pp. 32394-32403).*
Sato et al (FEBS Letters (2008), 582(7), 1093-1096).*
Sendersky et al (Molecular Microbiology (2005), 58(3), 659-668).*
Luque et al (Molecular Microbiology (2001), 41(4), 937-947).*
Beckmann, et al., "Improvement of light to biomass conversion by de-regulation of light-harvesting protein translation in Chlamydomonas reinhardtii", Journal of Biotechnology, vol. 142, No. 1, Jun. 1, 2009, Elsevier Science Publishers, pp. 70-77.
Nakajima, et al., "Improvement of microalgal photosynthetic productivity by reducing the content of light harvesting pigment", retrieved on Nov. 4, 2015 at <<http://rd.springer.com/content/pdf/10.1023/A:1008015224029.pdf>>, Journal of Applied Phycology, Kluwer Academic Publishers, Apr. 1, 1999, pp. 195-201.
PCT Invitation to Pay Additional Fees mailed Nov. 30, 2015 for PCT Application No. PCT/US15/50280, 9 pages.
Ruffing, "Engineered cyanobacteria Teaching an old bug new tricks", Bioengineered Bugs, vol. 2, No. 3, May 1, 2011, Sandia National Laboratories, pp. 136-149.
Swanson, et al., "Characterization of Phycocyanin Produced by cpcE and cpcF Mutants and Identification of an Identification of an Intergenic Suppressor of the Defect in Bilin Attachment", retrieved on Nov. 9, 2015 at <<http://www.jbc.org/content/267/23/16146.full.pdf>> The Journal of Biological Chemistry, vol. 267, No. 23, The American Society for Biochemistry and Molecular Biology, Inc., 1992, pp. 16146-16154.
"Appln. Environ. Microbiol.," American Society for Microbiology, Jun. 15, 2012, 14 pages.
Bailey, et al., "Photoprotection in Cyanobacteria: Regulation of Light Harvesting", Photochemistry and Photobiology, vol. 84, No. 6, Nov. 1, 2008, pp. 1410-1420.
Hofvander et al., "A prokaryotic acyl-CoA reductase performing reduction of fatty acyl-CoA to fatty alcohol", Elsevier B. B., FEBS Letters, Federation of European Biochemical Societies, 2011, 585, 6 pages.
Kwon, et al., "Reduced light-harvesting antenna: Consequences on cyanobacterial metabolism and photosynthetic productivity", Algal Research, vol. 2, No. 3, May 24, 2013, pp. 188-195.
MacIntyre, et al., "Photoacclimation of Photosynthesis Irradiance Response Curves and Photosynthetic Pigments in Microalgae and Cyanobacteria", Journal of Phycology, vol. 38, No. 1, Feb. 1, 2002, pp. 17-38.
Nakajima, et al., "Improvement of photosynthesis in dense microalgal suspension by reduction of light harvesting pigments", Journal of Applied Phycology, vol. 9, Dec. 1, 1997, pp. 503-510.
Nakajima, et al., "Reduced photoinhibition of a phycocyanin-deficient mutant of Synechocystis PCC 6714", Journal of Applied Phycology, vol. 10, No. 5, Jan. 1, 1998, pp. 447-452.
Page, et al., "Reduction of Photoautotrophic Productivity in the *Cyanobacterium synechocystis* sp. Strain PCC 6803 by Phycobilisome Antenna Truncation", Applied and Environmental Microbiology, vol. 78, No. 17, Sep. 1, 2012, pp. 6349-6351.
PCT Correspondence dated Jul. 21, 2014 for PCT Application No. PCT/US14/22842, 10 Pages.
PCT Search Report and Written Opinion dated Oct. 7, 2014 for PCT Application No. PCT/US14/22842, 19 Pages.

(Continued)

*Primary Examiner* — Jennifer Graser
(74) *Attorney, Agent, or Firm* — Cooley LLP

(57) ABSTRACT

This disclosure describes modified photosynthetic microorganisms, including Cyanobacteria, that have a reduced amount of a light harvesting protein (LHP) and contain one or more introduced or overexpressed polynucleotides encoding one or more enzymes associated with lipid biosynthesis, and which are capable of producing increased amounts of fatty acids and/or synthesizing triglycerides.

23 Claims, 23 Drawing Sheets

(56) References Cited

OTHER PUBLICATIONS

Ruffing, et al., "Physiological Effects of Free Fatty Acid Production in Genetically Engineered Synechococcus elongatus PCC 7942", Biotechnology and Bioengineering, vol. 109, No. 9, Sep. 9, 2012, pp. 2190-2199.
PCT Search Report and Written Opinion dated Feb. 9, 2016 for PCT application No. PCT/US2015/050280, 20 pages.
Lea-Smith, et al., "Phycobilisome-Deficient Strains of *Synechocystis* sp. PCC 6803 Have Reduced Size and Require Carbon-Limiting Conditions to Exhibit Enhanced Productivity," Plant Physiology, vol. 165(2), Jun. 2014, pp. 705-714.
Page, et al., "Reduction of Photoautotrophic Productivity in the *Cyanobacterium synechocystis* sp. Strain PCC 6803 by Phycobilisome Antenna Truncation," Applied Environmental Microbiology, vol. 78(17), Sep. 2012, pp. 6349-6351.
The Australian Office Action dated Sep. 4, 2017 for Australian Patent Application No. 2014249256, a counterpart foreign application of U.S. Appl. No. 14/775,606, 5 pages.
Gao, et al., "A Novel Cyanophage with a Cyanobacterial Nonbleaching Protein A Gene in the Genome", Journal of Virology, Jan. 2012, vol. 86, No. 1, pp. 236-245.

\* cited by examiner

CYANOBACTERIA HAVING IMPROVED PHOTOSYNTHETIC ACTIVITY

CROSS-REFERENCE TO RELATED PATENT APPLICATIONS

This application claims priority to and is a national phase application of PCT Patent Application No. PCT/US14/22842, filed Mar. 10, 2014, entitled "Cyanobacteria Having Improved Photosynthetic Activity," which claims priority to U.S. Provisional Patent Application No. 61/780,755 filed on Mar. 13, 2013, entitled "Cyanobacteria Having Improved Photosynthetic Activity," which are hereby incorporated by reference in their entirety.

SEQUENCE LISTING

The Sequence Listing associated with this application is provided in text format in lieu of a paper copy, and is hereby incorporated by reference into the specification. The name of the text file containing the Sequence Listing is M077-0013USP1_sequence listing_ST25.txt. The text file is about 661 KB, was created on Mar. 12, 2013, and is being submitted electronically via EFS-Web.

BACKGROUND

Certain organisms can be utilized as a source of oil such as triglycerides in the production of biofuels. For example, algae naturally produce triglycerides as energy storage molecules, and certain biofuel-related technologies are presently focused on the use of algae as a feedstock for biofuels. Algae are photosynthetic organisms, and the use of triglyceride-producing organisms such as algae provides the ability to produce biodiesel from sunlight, water, $CO_2$, macronutrients, and micronutrients. Algae, however, cannot be readily genetically manipulated, and produce much less oil (i.e., triglycerides) under culture conditions than in the wild.

Like algae, Cyanobacteria obtain energy from photosynthesis, utilizing chlorophyll A and water to reduce $CO_2$. Certain Cyanobacteria can produce metabolites, such as carbohydrates, proteins, and fatty acids, from just sunlight, $CO_2$, water, and inorganic salts. Unlike algae, Cyanobacteria can be genetically manipulated. For example, *S. elongatus* PCC 7942 (hereafter referred to as "*S. elongatus* PCC 7942") is a genetically manipulable, oligotrophic Cyanobacterium that thrives in low nutrient level conditions, and in the wild accumulates fatty acids in the form of lipid membranes to about 4 to 8% by dry weight. Cyanobacteria express light harvesting protein (LHP), which collects photons (i.e., light energy) and channel their energy to the photosynthetic reaction centers. However, although these proteins are extremely efficient at harvesting light, their capacity to use light for photosynthesis is easily saturated.

Clearly, therefore, there is a need in the art for modified photosynthetic microorganisms, including Cyanobacteria, capable of performing improved photosynthetic activity and producing oil such as triglycerides, e.g., to be used as feedstock in the production of biofuels and/or various specialty chemicals.

BRIEF SUMMARY

Embodiments of the present invention relate to the demonstration that photosynthetic microorganisms, including Cyanobacteria, can be modified to reduce expression of light harvesting proteins and unexpectedly increase photosynthetic activity. The modified Cyanobacteria can be cultured to produce carbon-containing compounds such as lipids and triglycerides. In certain embodiments, the modified photosynthetic microorganisms, e.g., Cyanobacteria, of the present invention can also comprise one or more polynucleotides encoding one or more enzymes associated with neutral lipid synthesis and lipid packaging protein.

In some embodiments, the present disclosure includes a cell culture comprising modified Cyanobacteria that have a reduced amount of a light harvesting protein (LHP), wherein, as compared to corresponding wild-type Cyanobacteria, the modified Cyanobacterium grow, divide or both at an increased rate, and/or have an increased level of photosynthetic activity.

In some embodiments, the present disclosure includes a method for generating modified Cyanobacteria that comprises modifying one or more polynucleotides associated with light harvesting proteins of Cyanobacteria to generate the modified Cyanobacteria, wherein the modified cyanobacteria have an increased level of photosynthetic activity as compared to corresponding wild-type Cyanobacteria. In these embodiments and other embodiments, the present disclosure include a method for generating modified Cyanobacteria, comprising: culturing Cyanobacteria under a stress condition; and isolating modified Cyanobacteria that have an increased level of photosynthetic activity as compared to corresponding wild-type Cyanobacteria, wherein the stress condition comprises culturing under increased light, culturing in metronidazole containing growth media or both.

In some embodiments, the present disclosure includes a modified Cyanobacterium comprising a reduced amount of a light harvesting protein as compared to a corresponding wild-type Cyanobacterium. In particular embodiments, the modified Cyanobacterium has reduced expression of one or more genes of light harvesting protein biosynthesis or transportation pathway as compared to the corresponding wild-type Cyanobacterium.

In some embodiments, the present disclosure includes a method for producing a carbon-containing compound, comprising: culturing modified Cyanobacteria comprising a reduced amount of a light harvesting protein as compared to a corresponding wild-type Cyanobacteria to thereby produce a carbon-containing compound; and harvesting the carbon-containing compound, wherein the modified cyanobacteria have an increased level of photosynthetic activity as compared to the corresponding wild-type Cyanobacteria.

In particular embodiments of the modified Cyanobacteria/Cyanobacterium and the related cell culture as well as the methods, the modified Cyanobacteria/Cyanobacterium contain modulations of the nblA, rpaB, pbsB, pbsC, or Phycobiliprotein gene, individually or in various combinations, may produce and accumulate significantly reduced levels of LHP as compared to wild-type Cyanobacteria. In some instances, the photosynthetic activity is measured based on at least one of a growth rate, a level of oxygen evolution, or a biomass accumulation rate.

DETAILED DESCRIPTION

Definitions

Figure 1A:
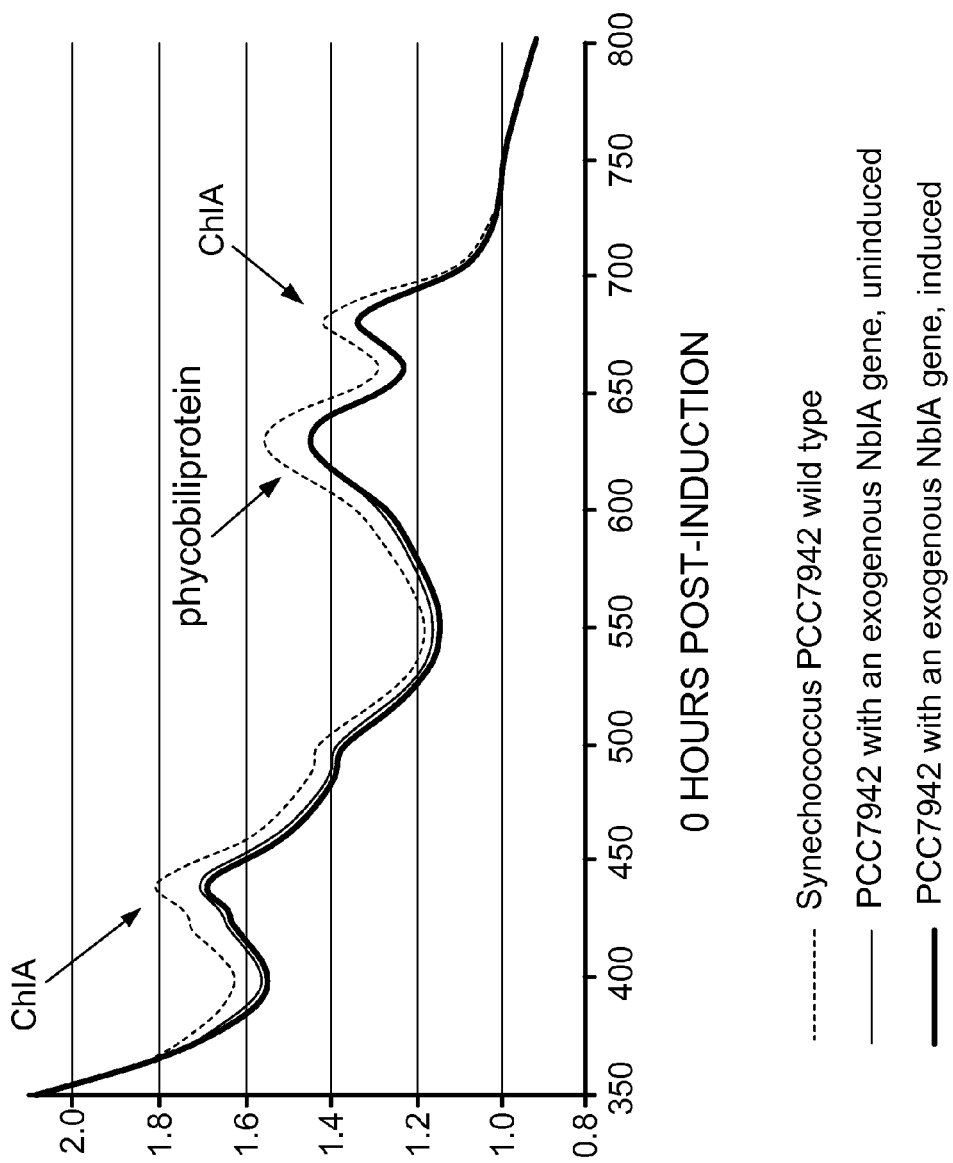
FIGS. 1A and 1B show a measurement of phycobilisomes, comparing wild-type to NblA overexpressor. *Synechococcus* PCC7942 wild type, PCC7942 with an exogenous NblA gene, uninduced or PCC7942 with an exogenous NblA gene, induced. Samples were collected at time zero (FIG. 1A) and at six hours (FIG. 1B) after induction of the NblA gene. Whole cells were examined by spectrophotometry, and absorbance as a function of wavelength was determined. The three major peaks represent absorption by chlorophyll A (at approximately 420 and 680 nm) and by phycobiliprotein (at approximately 630 nm). Induction of NblA caused a rapid decrease in light absorption by phycobiliprotein. Some reduction in the 680 nm chlorophyll A peak was also observed. These data show that phycobilisomes are reduced after modulated NblA expression, indicating that modulating NblA expression reduce phycobilisome abundance.

Unless defined otherwise, all technical and scientific terms used herein have the same meaning as commonly understood by those of ordinary skill in the art to which the invention belongs. Although any methods and materials similar or equivalent to those described herein can be used in the practice or testing of the present invention, exemplary methods and materials are described. For the purposes of the present invention, the following terms are defined below.

The articles "a" and "an" are used herein to refer to one or to more than one (i.e. to at least one) of the grammatical object of the article. By way of example, "an element" means one element or more than one element.

By "about" is meant a quantity, level, value, number, frequency, percentage, dimension, size, amount, weight or length that varies by as much as 30, 25, 20, 15, 10, 9, 8, 7, 6, 5, 4, 3, 2 or 1% to a reference quantity, level, value, number, frequency, percentage, dimension, size, amount, weight or length.

The term "biologically active fragment", as applied to fragments of a reference polynucleotide or polypeptide sequence, refers to a fragment that has at least about 0.1, 0.5, 1, 2, 5, 10, 12, 14, 16, 18, 20, 22, 24, 26, 28, 30, 35, 40, 45, 50, 55, 60, 65, 70, 75, 80, 85, 90, 95, 96, 97, 98, 99, 100, 110, 120, 150, 200, 300, 400, 500, 600, 700, 800, 900, 1000% or more of the activity of a reference sequence. The term "reference sequence" refers generally to a nucleic acid coding sequence, or amino acid sequence, of any enzyme having a diacylglycerol acyltransferase activity, a phosphatidate phosphatase activity, and/or an acetyl-CoA carboxylase activity, as described herein (see, e.g., SEQ ID NOS: 1-9).

Included within the scope of the present invention are biologically active fragments of at least about 18, 19, 20, 21, 22, 23, 24, 25, 26, 27, 28, 29, 30, 40, 50, 60, 70, 80, 90, 100, 120, 140, 160, 180, 200, 220, 240, 260, 280, 300, 320, 340, 360, 380, 400, 500, 600 or more contiguous nucleotides or amino acid residues in length, including all integers in between, which comprise or encode a polypeptide having an enzymatic activity of a reference polynucleotide or polypeptide. Representative biologically active fragments generally participate in an interaction, e.g., an intra-molecular or an inter-molecular interaction. An inter-molecular interaction can be a specific binding interaction or an enzymatic interaction. Examples of enzymatic interactions or activity include diacylglycerol acyltransferase activity, phosphatidate phosphatase activity, and/or acetyl-CoA carboxylase activity, as described herein.

By "coding sequence" is meant any nucleic acid sequence that contributes to the code for the polypeptide product of a gene. By contrast, the term "non-coding sequence" refers to any nucleic acid sequence that does not contribute to the code for the polypeptide product of a gene.

Throughout this specification, unless the context requires otherwise, the words "comprise", "comprises" and "comprising" will be understood to imply the inclusion of a stated step or element or group of steps or elements but not the exclusion of any other step or element or group of steps or elements.

By "consisting of" is meant including, and limited to, whatever follows the phrase "consisting of." Thus, the phrase "consisting of" indicates that the listed elements are required or mandatory, and that no other elements may be present.

By "consisting essentially of" is meant including any elements listed after the phrase, and limited to other elements that do not interfere with or contribute to the activity or action specified in the disclosure for the listed elements. Thus, the phrase "consisting essentially of" indicates that the listed elements are required or mandatory, but that other elements are optional and may or may not be present depending upon whether or not they affect the activity or action of the listed elements.

The terms "complementary" and "complementarity" refer to polynucleotides (i.e., a sequence of nucleotides) related by the base-pairing rules. For example, the sequence "A-G-T," is complementary to the sequence "T-C-A." Complementarity may be "partial," in which only some of the nucleic acids' bases are matched according to the base pairing rules. Or, there may be "complete" or "total" complementarity between the nucleic acids. The degree of complementarity between nucleic acid strands has significant effects on the efficiency and strength of hybridization between nucleic acid strands.

By "corresponds to" or "corresponding to" is meant (a) a polynucleotide having a nucleotide sequence that is substantially identical or complementary to all or a portion of a reference polynucleotide sequence or encoding an amino acid sequence identical to an amino acid sequence in a peptide or protein; or (b) a peptide or polypeptide having an amino acid sequence that is substantially identical to a sequence of amino acids in a reference peptide or protein.

By "derivative" is meant a polypeptide that has been derived from the basic sequence by modification, for example by conjugation or complexing with other chemical moieties (e.g., pegylation) or by post-translational modification techniques as would be understood in the art. The term "derivative" also includes within its scope alterations that have been made to a parent sequence including additions or deletions that provide for functionally equivalent molecules.

By "enzyme reactive conditions" it is meant that any necessary conditions are available in an environment (i.e., such factors as temperature, pH, and lack of inhibiting substances) which will permit the enzyme to function. Enzyme reactive conditions can be either in vitro, such as in a test tube, or in vivo, such as within a cell.

As used herein, the terms "function" and "functional" and the like refer to a biological, enzymatic, or therapeutic function.

By "gene" is meant a unit of inheritance that occupies a specific locus on a chromosome and consists of transcriptional and/or translational regulatory sequences and/or a coding region and/or non-translated sequences (i.e., introns, 5' and 3' untranslated sequences).

"Homology" refers to the percentage number of amino acids that are identical or constitute conservative substitutions. Homology may be determined using sequence comparison programs such as GAP (Deveraux et al., 1984, *Nucleic Acids Research* 12, 387-395) which is incorporated herein by reference. In this way sequences of a similar or substantially different length to those cited herein could be compared by insertion of gaps into the alignment, such gaps being determined, for example, by the comparison algorithm used by GAP.

The term "host cell" includes an individual cell or cell culture which can be or has been a recipient of any recombinant vector(s) or isolated polynucleotide of the invention. Host cells include progeny of a single host cell, and the progeny may not necessarily be completely identical (in morphology or in total DNA complement) to the original parent cell due to natural, accidental, or deliberate mutation and/or change. A host cell includes cells transfected or infected in vivo or in vitro with a recombinant vector or a polynucleotide of the invention. A host cell which comprises a recombinant vector of the invention is a recombinant host cell.

By "isolated" is meant material that is substantially or essentially free from components that normally accompany it in its native state. For example, an "isolated polynucleotide", as used herein, refers to a polynucleotide, which has been purified from the sequences which flank it in a naturally-occurring state, e.g., a DNA fragment which has been removed from the sequences that are normally adjacent to the fragment. Alternatively, an "isolated peptide" or an "isolated polypeptide" and the like, as used herein, refer to in vitro isolation and/or purification of a peptide or polypeptide molecule from its natural cellular environment, and from association with other components of the cell.

By "increased" or "increasing" is meant the ability of one or more modified photosynthetic microorganisms, e.g., Cyanobacteria, to produce a greater amount of a given fatty acid, lipid molecule, or triglyceride as compared to a control Cyanobacteria, such as an unmodified Cyanobacteria or a differently modified Cyanobacteria. Production of fatty acids can be measured according to techniques known in the art, such as Nile Red staining and gas chromatography. Production of triglycerides can be measured, for example, using commercially available enzymatic tests, including colorimetric enzymatic tests using glycerol-3-phosphate-oxidase.

As used herein, "light harvesting protein" (LHP), means a protein that may be part of or associated with a larger supercomplex of a photosystem, the functional unit in photosynthesis. The LHP is used, for example, by plants and photosynthetic bacteria to collect more of the incoming light (e.g. photons) than would be captured by the photosynthetic reaction center alone. LHP may include light harvesting antenna proteins (phycobiliproteins, such as phycocyanin, allophycocyanin, phycoerythrin and evolutionarily related phycobiliproteins), enzymes necessary for synthesis of light harvesting chromophores (the bilins, such as phycocyanobilin, phycoerythrobilin, phycourobilin), enzymes necessary for assembling light harvesting chromophores onto phycobiliproteins (known as lyases), light harvesting antenna linker proteins, and chlorophyll binding proteins.

As used herein "light limiting conditions" means that the rate of photosynthetic or light harvesting activity and/or carbon fixation associated with photosynthetic microorganisms is limited by the amount of light available (as opposed to nutrient limiting conditions, or CO2 limiting conditions, for example).

As used herein, "neutral lipid" means any lipid that is soluble only in solvents of very low polarity. Neutral lipids are divided into two main groups: (1) acylglycerols (glycerides), i.e. fatty-acid esters of glycerol; and (2) waxes, i.e. fatty-acid esters of long-chain monohydroxy alcohols. More precisely called a fatty acid ester. Arises from the joining of the fatty acid carboxyl group to a hydroxyl group to make an ester bond. This can occur, for example, between a fatty acid and glycerol to make mono, di and triglycerides, or between a fatty acid and an alcohol to make a wax ester.

By "obtained from" is meant that a sample such as, for example, a polynucleotide extract or polypeptide extract is isolated from, or derived from, a particular source, such as a desired organism or a specific tissue within a desired organism. "Obtained from" can also refer to the situation in which a polynucleotide or polypeptide sequence is isolated from, or derived from, a particular organism or tissue within an organism. For example, a polynucleotide sequence encoding a diacylglycerol acyltransferase, phosphatidate phosphatase, and/or acetyl-CoA carboxylase enzyme may be isolated from a variety of prokaryotic or eukaryotic organisms, or from particular tissues or cells within certain eukaryotic organism.

The term "operably linked" as used herein means placing a gene under the regulatory control of a promoter, which then controls the transcription and optionally the translation of the gene. In the construction of heterologous promoter/structural gene combinations, it is generally preferred to position the genetic sequence or promoter at a distance from the gene transcription start site that is approximately the same as the distance between that genetic sequence or promoter and the gene it controls in its natural setting; i.e. the gene from which the genetic sequence or promoter is derived. As is known in the art, some variation in this distance can be accommodated without loss of function. Similarly, the preferred positioning of a regulatory sequence element with respect to a heterologous gene to be placed under its control is defined by the positioning of the element in its natural setting; i.e., the genes from which it is derived. "Constitutive promoters" are typically active, i.e., promote transcription, under most conditions. "Inducible promoters" are typically active only under certain conditions, such as in the presence of a given molecule factor (e.g., IPTG) or a given environmental condition (e.g., particular $CO_2$ concentration, nutrient levels, light, heat). In the absence of that condition, inducible promoters typically do not allow significant or measurable levels of transcriptional activity. For example, inducible promoters may be induced according to temperature, pH, a hormone, a metabolite (e.g., lactose, mannitol, an amino acid), light (e.g., wavelength specific), osmotic potential (e.g., salt induced), a heavy metal, or an antibiotic. Numerous standard inducible promoters will be known to one of skill in the art.

The recitation "polynucleotide" or "nucleic acid" as used herein designates mRNA, RNA, cRNA, rRNA, cDNA or DNA. The term typically refers to polymeric form of nucleotides of at least 10 bases in length, either ribonucleotides or deoxynucleotides or a modified form of either type of nucleotide. The term includes single and double stranded forms of DNA.

The terms "polynucleotide variant" and "variant" and the like refer to polynucleotides displaying substantial sequence identity with a reference polynucleotide sequence or polynucleotides that hybridize with a reference sequence under stringent conditions that are defined hereinafter. These terms also encompass polynucleotides that are distinguished from a reference polynucleotide by the addition, deletion or substitution of at least one nucleotide. Accordingly, the terms "polynucleotide variant" and "variant" include polynucleotides in which one or more nucleotides have been added or deleted, or replaced with different nucleotides. In this regard, it is well understood in the art that certain alterations inclusive of mutations, additions, deletions and substitutions can be made to a reference polynucleotide whereby the altered polynucleotide retains the biological function or activity of the reference polynucleotide, or has increased activity in relation to the reference polynucleotide (i.e., optimized). Polynucleotide variants include, for example, polynucleotides having at least 50% (and at least 51% to at least 99% and all integer percentages in between) sequence identity with a reference polynucleotide sequence that encodes a diacylglycerol acyltransferase, a phosphatidate phosphatase, and/or an acetyl-CoA carboxylase enzyme. The terms "polynucleotide variant" and "variant" also include naturally-occurring allelic variants and orthologs that encode these enzymes.

With regard to polynucleotides, the term "exogenous" refers to a polynucleotide sequence that does not naturally occur in a wild-type cell or organism, but is typically introduced into the cell by molecular biological techniques. Examples of exogenous polynucleotides include vectors, plasmids, and/or man-made nucleic acid constructs encoding a desired protein. With regard to polynucleotides, the term "endogenous" or "native" refers to naturally occurring polynucleotide sequences that may be found in a given wild-type cell or organism. For example, certain cyanobacterial species do not typically contain a DGAT gene, and, therefore, do not comprise an "endogenous" polynucleotide sequence that encodes a DGAT polypeptide. Also, a particular polynucleotide sequence that is isolated from a first organism and transferred to second organism by molecular biological techniques is typically considered an "exogenous" polynucleotide with respect to the second organism.

"Polypeptide," "polypeptide fragment," "peptide" and "protein" are used interchangeably herein to refer to a polymer of amino acid residues and to variants and synthetic analogues of the same. Thus, these terms apply to amino acid polymers in which one or more amino acid residues are synthetic non-naturally occurring amino acids, such as a chemical analogue of a corresponding naturally occurring amino acid, as well as to naturally-occurring amino acid polymers. In certain aspects, polypeptides may include enzymatic polypeptides, or "enzymes," which typically catalyze (i.e., increase the rate of) various chemical reactions.

The recitation polypeptide "variant" refers to polypeptides that are distinguished from a reference polypeptide sequence by the addition, deletion or substitution of at least one amino acid residue. In certain embodiments, a polypeptide variant is distinguished from a reference polypeptide by one or more substitutions, which may be conservative or non-conservative. In certain embodiments, the polypeptide variant comprises conservative substitutions and, in this regard, it is well understood in the art that some amino acids may be changed to others with broadly similar properties without changing the nature of the activity of the polypeptide. Polypeptide variants also encompass polypeptides in which one or more amino acids have been added or deleted, or replaced with different amino acid residues.

The present invention contemplates the use in the methods described herein of variants of full-length enzymes having, photosynthetic or light harvesting activity, diacylglycerol acyltransferase activity, phosphatidate phosphatase activity, and/or acetyl-CoA carboxylase activity, truncated fragments of these full-length polypeptides, variants of truncated fragments, as well as their related biologically active fragments. Typically, biologically active fragments of a polypeptide may participate in an interaction, for example, an intra-molecular or an inter-molecular interaction. An inter-molecular interaction can be a specific binding interaction or an enzymatic interaction (e.g., the interaction can be transient and a covalent bond is formed or broken). Biologically active fragments of a polypeptide/enzyme having a light harvesting activity, diacylglycerol acyltransferase activity, a phosphatidate phosphatase activity, and/or acetyl-CoA carboxylase activity include peptides comprising amino acid sequences sufficiently similar to, or derived from, the amino acid sequences of a (putative) full-length reference polypeptide sequence. Typically, biologically active fragments comprise a domain or motif with at least one activity of a nblA polypeptide, an rpaB polypeptide, a pbsB polypeptide, a pbsC polypeptide, a Phycobiliprotein polypeptide, a diacylglycerol acyltransferase polypeptide, phosphatidate phosphatase polypeptide, and/or acetyl-coA carboxylase polypeptide, and may include one or more (and in some cases all) of the various active domains. A biologically active fragment of nblA, rpaB, pbsB, pbsC, Phycobiliprotein, diacylglycerol acyltransferase, phosphatidate phosphatase, and/or acetyl-CoA carboxylase polypeptide can be a polypeptide fragment which is, for example, 10, 11, 12, 13, 14, 15, 16, 17, 18, 19, 20, 21, 22, 23, 24, 25, 26, 27, 28, 29, 30, 40, 50, 60, 70, 80, 90, 100, 110, 120, 130, 140, 150, 160, 170, 180, 190, 200, 220, 240, 260, 280, 300, 320, 340, 360, 380, 400, 450, 500, 600 or more contiguous amino acids, including all integers in between, of a reference polypeptide sequence. In certain embodiments, a biologically active fragment comprises a conserved enzymatic sequence, domain, or motif, as described elsewhere herein and known in the art. Suitably, the biologically-active fragment has no less than about 1%, 10%, 25%, or 50% of an activity of the wild-type polypeptide from which it is derived.

A "reference sequence," as used herein, refers to a wild-type polynucleotide or polypeptide sequence from any organism, e.g., wherein the polynucleotide encodes a polypeptide having an acyl-ACP reductase, as described herein and known in the art. Exemplary polypeptide "reference sequences" are provided herein, including the polynucleotide and polypepetide sequences of an acyl-ACP reductase of *Synechococcus elongatus* PCC7942 (see SEQ ID NOs:1 and 2 for the polynucleotide and polypeptide sequences, respectively) and an acyl-ACP reductase of *Synechocystis* sp. PCC6803 (SEQ ID NOs:3 and 4 for the polynucleotide and polypeptide sequences, respectively), among others known to a person skilled in the art.

The recitations "sequence identity" or, for example, comprising a "sequence 50% identical to," as used herein, refer to the extent that sequences are identical on a nucleotide-by-nucleotide basis or an amino acid-by-amino acid basis over a window of comparison. Thus, a "percentage of sequence identity" may be calculated by comparing two optimally aligned sequences over the window of comparison, determining the number of positions at which the identical nucleic acid base (e.g., A, T, C, G, I) or the identical amino acid residue (e.g., Ala, Pro, Ser, Thr, Gly, Val, Leu, Ile, Phe, Tyr, Trp, Lys, Arg, His, Asp, Glu, Asn, Gln, Cys and Met) occurs in both sequences to yield the number of matched positions, dividing the number of matched positions by the total number of positions in the window of comparison (i.e., the window size), and multiplying the result by 100 to yield the percentage of sequence identity.

Terms used to describe sequence relationships between two or more polynucleotides or polypeptides include "reference sequence", "comparison window", "sequence identity", "percentage of sequence identity" and "substantial identity". A "reference sequence" is at least 12 but frequently 15 to 18 and often at least 25 monomer units, inclusive of nucleotides and amino acid residues, in length. Because two polynucleotides may each comprise (1) a sequence (i.e., only a portion of the complete polynucleotide sequence) that is similar between the two polynucleotides, and (2) a sequence that is divergent between the two polynucleotides, sequence comparisons between two (or more) polynucleotides are typically performed by comparing sequences of the two polynucleotides over a "comparison window" to identify and compare local regions of sequence similarity. A "comparison window" refers to a conceptual segment of at least 6 contiguous positions, usually about 50 to about 100, more usually about 100 to about 150 in which a sequence is compared to a reference sequence of the same number of contiguous positions after the two sequences are optimally aligned. The comparison window may comprise additions or deletions (i.e., gaps) of about 20% or less as compared to the reference sequence (which does not comprise additions or deletions) for optimal alignment of the two sequences. Optimal alignment of sequences for aligning a comparison window may be conducted by computerized implementations of algorithms (GAP, BESTFIT, FASTA, and TFASTA in the Wisconsin Genetics Software Package Release 7.0, Genetics Computer Group, 575 Science Drive Madison, Wis., USA) or by inspection and the best alignment (i.e., resulting in the highest percentage homology over the comparison window) generated by any of the various methods selected. Reference also may be made to the BLAST family of programs as for example disclosed by Altschul et al., 1997, *Nucl. Acids Res.* 25:3389. A detailed discussion of sequence analysis can be found in Unit 19.3 of Ausubel et al., "Current Protocols in Molecular Biology", John Wiley & Sons Inc, 1994-1998, Chapter 15.

As used herein, the term "triglyceride" (triacylglycerol or neutral fat) refers to a fatty acid triester of glycerol. Triglycerides are typically non-polar and water-insoluble. Phosphoglycerides (or glycerophospholipids) are major lipid components of biological membranes.

"Transformation" refers to the permanent, heritable alteration in a cell resulting from the uptake and incorporation of foreign DNA into the host-cell genome; also, the transfer of an exogenous gene from one organism into the genome of another organism.

By "vector" is meant a polynucleotide molecule, preferably a DNA molecule derived, for example, from a plasmid, bacteriophage, yeast or virus, into which a polynucleotide can be inserted or cloned. A vector preferably contains one or more unique restriction sites and can be capable of autonomous replication in a defined host cell including a target cell or tissue or a progenitor cell or tissue thereof, or be integrable with the genome of the defined host such that the cloned sequence is reproducible. Accordingly, the vector can be an autonomously replicating vector, i.e., a vector that exists as an extra-chromosomal entity, the replication of which is independent of chromosomal replication, e.g., a linear or closed circular plasmid, an extra-chromosomal element, a mini-chromosome, or an artificial chromosome. The vector can contain any means for assuring self-replication. Alternatively, the vector can be one which, when introduced into the host cell, is integrated into the genome and replicated together with the chromosome(s) into which it has been integrated. Such a vector may comprise specific sequences that allow recombination into a particular, desired site of the host chromosome. A vector system can comprise a single vector or plasmid, two or more vectors or plasmids, which together contain the total DNA to be introduced into the genome of the host cell, or a transposon. The choice of the vector will typically depend on the compatibility of the vector with the host cell into which the vector is to be introduced. In the present case, the vector is preferably one which is operably functional in a bacterial cell, such as a cyanobacterial cell. The vector can include a reporter gene, such as a green fluorescent protein (GFP), which can be either fused in frame to one or more of the encoded polypeptides, or expressed separately. The vector can also include a selection marker such as an antibiotic resistance gene that can be used for selection of suitable transformants.

The terms "wild-type" and "naturally occurring" are used interchangeably to refer to a gene or gene product that has the characteristics of that gene or gene product when isolated from a naturally occurring source. A wild type gene or gene product (e.g., a polypeptide) is that which is most frequently observed in a population and is thus arbitrarily designed the "normal" or "wild-type" form of the gene.

Modified Photosynthetic Microorganisms and Method of Generation Thereof

The present disclosure, therefore, relates generally to modified photosynthetic organisms, including modified Cyanobacteria, and methods of generation thereof, which have been modified to produce or store reduced levels of light harvesting protein (LHP) as compared to wild-type photosynthetic microorganisms. In particular embodiments, the modified photosynthetic organism is genetically modified, for instance, relative to the wild-type or most frequently observed photosynthetic organism of that same species. Genetic modifications can be man-made and/or naturally-occurring, for instance, by direct molecular biological intervention (e.g., cloning or insertion of exogenous genetic elements to modulate expression of genes associated with LHP synthesis/storage), directed evolution under controlled conditions to enhance natural selection of LHP-deficient or LHP-reduced mutants, or identification of spontaneous LHP-deficient or LHP-reduced mutants under natural conditions, including combinations thereof. For instance, Cyanobacteria, such as *Synechococcus*, which contain modulations of the nblA, rpaB, pbsB, pbsC, or Phycobiliprotein gene, individually or in various combinations, may produce and accumulate significantly reduced levels of LHP as compared to wild-type Cyanobacteria. These modified Cyanoabacterium while producing or storing reduced levels of LHP unexpectedly show increased photosynthetic activity.

Embodiments of the present disclosure include a cell culture comprising modified Cyanobacteria that have an increased level of photosynthetic activity as compared to corresponding wild-type Cyanobacteria, wherein the modified Cyanobacteria have a reduced amount of a LHP polypeptide as compared to a corresponding wild-type Cyanobacteria. In particular embodiments, the modified cyanobacteria grow and/or divide at an increased rate under a condition, such as a light-limited condition, as compared to the corresponding wild-type cyanobacteria. In particular embodiments, wherein the modified Cyanobacteria have reduced expression of one or more genes of light harvesting proteins biosynthesis and/or transportation pathway as compared to the corresponding wild-type Cyanobacteria.

In some embodiments, the modified Cyanobacterium has a reduced level of expression of one or more genes of a LHP biosynthesis or storage pathway and/or overexpresses one or more genes or proteins of a LHP breakdown pathway, such that the modified Cyanobacterium synthesizes or accumulates a reduced amount of LHP, as compared to a wild-type Cyanobacterium. In one embodiment, the modified Cyanobacterium comprises one or more mutations or deletions in one or more genes of a LHP biosynthesis or storage pathway, which may be, e.g., complete or partial gene deletions. In other embodiments, the modified Cyanobacteria comprise one or more polynucleotides comprising an antisense RNA sequence that targets, e.g., hybridizes to, one or more genes or mRNAs of a LHP biosynthesis or storage pathway, such as an antisense oligonucleotide or a short interfering RNA (siRNA), or a vector that expresses one or more such polynucleotides.

In certain embodiments, individual Cyanobacteria of the modified Cyanobacteria have a reduced amount of phycobilisomes as compared to the corresponding wild-type Cyanobacteria. In specific embodiments, the modified Cyanobacteria have an increased proteolytic degradation of phycobilisomes as compared to the corresponding wild-type Cyanobacteria. In specific embodiments, the modified Cyanobacteria have an increased expression of an NblA gene as compared to the corresponding wild-type Cyanobacteria. In these embodiments, the modified Cyanobacteria have a reduction of light harvesting proteins of from 10% to 60%, from 30% to 50%, or from 35% to 45%. In certain embodiments, the Cyanobacterium are modified to have a 40% reduction of light harvesting proteins. In still other embodiments, the Cyanobacterium is modified to have at least a 10%, 15%, 20%, 25%, 30%, 35%, 40%, 45%, 50%, 55% or 60% reduction of light harvesting proteins. In yet other embodiments, the Cyanobacterium is modified to have no more than a 60%, 55%, 50%, 45%, 40%, 35%, 30%, 25%, 20%, 15% or 5% reduction of light harvesting proteins. In specific embodiments, the increased expression of the NblA gene comprises the increased expression of an endogenous NblA gene as compared to the corresponding wild-type Cyanobacteria. In some instances, the expression of the NblA gene is increased by replacing a promoter of the NblA gene.

In certain embodiments, the modified Cyanobacteria have a reduced level of light harvesting proteins as compared to the corresponding wild-type Cyanobacteria. In specific embodiments, the modified Cyanobacteria have reduced expression of an RpaB gene and/or reduced RpaB activity as compared to the corresponding wild-type Cyanobacteria. In specific embodiments, the modified Cyanobacteria have over-expressed N terminal fragments of the RpaB gene. In specific embodiments, the level of RpaB activity is reduced by replacing a promoter of the RpaB gene. For example, N terminal fragments of the RpaB gene may be over-expressed by replacing a promoter of the RpaB gene.

In certain embodiments, the modified Cyanobacteria have a reduced level of photosystem II light harvesting proteins as compared to the corresponding wild-type Cyanobacteria. In specific embodiments, the modified Cyanobacteria have a reduced expression of a PbsB gene or a PbsC gene as compared to the corresponding wild-type Cyanobacteria. In specific embodiments, the reduced expression of the PbsB gene or the PbsC gene comprises the reduced expression of an endogenous PbsB gene or an endogenous PbsC gene as compared to the corresponding wild-type Cyanobacteria. In some embodiments, the expression of the PbsB gene or the PbsC gene gene is reduced by replacing a promoter of one of the PbsB gene and the PbsC gene.

In certain embodiments, the modified Cyanobacteria have a reduced amount of phycobiliproteins as compared to the corresponding wild-type Cyanobacteria. In specific embodiments, the modified Cyanobacterium have a reduced expression of phycocyanin genes or allophycocyanin genes as compared to the corresponding wild-type Cyanobacterium. In specific embodiments, the reduced expression of the phycocyanin genes or allophycocyanin comprises the reduced expression of endogenous phycocyanin genes or allophycocyanin genes as compared to the corresponding wild-type Cyanobacteria. In some instances, the expression of the phycocyanin genes or allophycocyanin genes is reduced by replacing one or more promoters of the phycocyanin genes and allophycocyanin genes.

Embodiments of the present disclosure also include methods for generating modified cyanobacteria. In some embodiments, the method comprises modifying one or more polynucleotides associated with light harvesting proteins (LHP) of Cyanobacteria to generate the modified Cyanobacteria, wherein the modified cyanobacteria have an increased level of photosynthetic activity as compared to corresponding wild-type Cyanobacteria. In these and other embodiments, the method comprises culturing Cyanobacteria under a stress condition; and isolating modified Cyanobacteria that have an increased level of photosynthetic activity as compared to corresponding wild-type Cyanobacteria, wherein the stress condition comprises culturing under increased light, culturing in metronidazole containing growth media or both.

In certain embodiments, the culture is maintained at an optical cell density ranging from 0.25-2.0, 0.5-1.5, or about 1.0, i.e., within 10% of 1.0. In certain embodiments, the cultured modified Cyanobacteria show an increased growth rate, increased oxygen evolution or both when compared with a corresponding wild-type Cyanobacteria. For example, a growth rate of the cultured modified Cyanobacteria may be at least 10% or at least 20% greater than a growth rate of a corresponding microorganism grown in light limiting conditions. In other embodiments, a growth rate of the microorganism is at least about 1.5, 2, 3, 4, 5, 6, 7, 8, 9, 10 or 20-fold greater than a growth rate of a corresponding Cyanobacteria.

In certain aspects, the modified photosynthetic organisms described herein are further modified to increase production of lipids, for instance, by introducing and/or overexpressing one or more polypeptides associated with lipid biosynthesis. Examples of such lipids include fatty acids, fatty alcohols, fatty aldehydes, alkane/alkenes, triglycerides, and wax esters. Hence, in some instances, modified photosynthetic microorganisms that accumulate a reduced amount of LHP as compared to the wild-type photosynthetic microorganism can further comprise one or more introduced or overexpressed polynucleotides encoding one or more of an acyl carrier protein (ACP), acyl ACP synthase (Aas), acyl-ACP reductase, alcohol dehydrogenase, aldehyde dehydrogenase, aldehyde decarbonylase, thioesterase (TES), acetyl coenzyme A carboxylase (ACCase), diacylglycerol acyltransferase (DGAT), phosphatidic acid phosphatase (PAP; or phosphatidate phosphatase), triacylglycerol (TAG) hydrolase, fatty acyl-CoA synthetase, lipase/phospholipase, fatty acyl reductase (FAR) or any combination thereof.

Certain embodiments thus include modified photosynthetic microorganisms that accumulate a reduced amount of LHP as compared to the wild-type photosynthetic microorganism, and which comprise one or more introduced polynucleotides that encode an enzyme having DGAT activity. Optionally, to further increase production of triglycerides, such photosynthetic microorganisms can further comprise one or more introduced or overexpressed polynucleotides that encode a phosphatidate phosphatase, ACCase, ACP, phospholipase B, phospholipase C, fatty acyl Co-A synthetase, or any combination thereof. Certain embodiments include an introduced DGAT in combination with an introduced or overexpressed ACCase, PAP, or both.

Certain embodiments of the present disclosure relate to modified photosynthetic organisms, including Cyanobacteria, and methods of use thereof, wherein the modified photosynthetic microorganisms further comprise one or more over-expressed, exogenous, or introduced polynucleotides encoding an acyl-ACP reductase polypeptide, or a fragment or variant thereof. In particular embodiments, the fragment or variant thereof retains at least 50% of one or more activity of the wild-type acyl-ACP reductase polypeptide. As with most any of the overexpressed polypeptides described herein, an overexpressed acyl-ACP reductase can be encoded by an endogenous or naturally-occurring polynucleotide which is operably linked to an introduced promoter, typically upstream of the microorganism's natural acyl-ACP reductase coding region, and/or it can be encoded by an introduced polynucleotide that encodes an acyl-ACP reductase.

In certain embodiments, an introduced promoter is inducible, and in some embodiments it is constitutive. Included are weak promoters under non-induced conditions. Exemplary promoters are described elsewhere herein and known in the art. In particular embodiments, the introduced promoter is exogenous or foreign to the photosynthetic microorganism, i.e., it is derived from a genus/species that differs from the microorganism being modified. In other embodiments, the introduced promoter is a recombinantly introduced copy of an otherwise endogenous or naturally-occurring promoter sequence, i.e., it is derived from the same species of microorganism being modified.

Similar principles can apply to the introduced polynucleotide which encodes the acyl-ACP reductase or other overexpressed polypeptide (e.g., aldehyde dehydrogenase). For instance, in particular embodiments, the introduced polynucleotide encoding the acyl-ACP reductase or other polypeptide is exogenous or foreign to the photosynthetic microorganism, i.e., it is derived from a genus/species that differs from the microorganism being modified. In other embodiments, the introduced polynucleotide is a recombinantly introduced copy of an otherwise endogenous or naturally-occurring sequence, i.e., it is derived from the same species of microorganism being modified.

Acyl-ACP reductase polypeptides, and fragments and variants thereof that may be used according to the compositions and methods of the present disclosure are described herein. The present disclosure contemplates the use of naturally-occurring and non-naturally-occurring variants of these acyl-ACP reductase and other lipid biosynthesis proteins (e.g., ACP, ACCase, DGAT, acyl-CoA synthetase, aldehyde dehydrogenase), as well as variants of their encoding polynucleotides. These enzyme encoding sequences may be derived from any microorganism (e.g., plants, bacteria) having a suitable sequence, and may also include any man-made variants thereof, such as any optimized coding sequences (i.e., codon-optimized polynucleotides) or optimized polypeptide sequences.

Acyl-ACP reductase polypeptides may also be overexpressed in strains of photosynthetic microorganisms that have been modified to overexpress one or more selected lipid biosynthesis proteins (e.g., selected fatty acid biosynthesis proteins, triacylglycerol biosynthesis proteins, alkane/alkene biosynthesis proteins, wax ester biosynthesis proteins).

For example, to produce triglycerides, a modified photosynthetic microorganism may comprise an overexpressed acyl-ACP reductase in combination with an introduced polynucleotide that encodes a DGAT. In these and related embodiments, triglyceride production can be further increased by introduction or overexpression of an aldehyde dehydrogenase, for instance, to increase production of fatty acids, the precursors to triglycerides. One exemplary aldehyde dehydrogenase is encoded by orf0489 of *Synechococcus elongatus* PCC7942. Also included are homologs or paralogs thereof, functional equivalents thereof, and fragments or variants thereofs. Functional equivalents can include aldehyde dehydrogenases with the ability to convert acyl aldehydes (e.g., nonyl-aldehyde) into fatty acids. In certain embodiments, the aldehyde dehydrogenase has the amino acid sequence of SEQ ID NO:103 (encoded by the polynucleotide sequence of SEQ ID NO:102), or an active fragment or variant of this sequence. These and related embodiments can be further combined with reduced expression and/or activity of an endogenous aldehyde decarbonylase (e.g., orf1593 in *S. elongatus*), described herein, to shunt carbon away from alkanes and towards fatty acids, the precursors to triglycerides.

To produce wax esters, a modified photosynthetic microorganism may comprise an overexpressed acyl-ACP reductase and an introduced polynucleotide that encodes a DGAT (e.g., a bi-functional DGAT having wax ester synthase activity) in further combination with an introduced or overexpressed polynucleotide that encodes an alcohol dehydrogenase, such as a long-chain alcohol dehydrogenase. Exemplary alcohol dehydrogenases include slr1192 from *Synechocystis* sp. PCC6803 and ACIAD3612 from *Acinetobacter baylii* (see SEQ ID NOS:104-107). Also included are homologs or paralogs thereof, functional equivalents thereof, and fragments or variants thereofs. Functional equivalents can include alcohol dehydrogenases with the ability to convert acyl aldehydes (e.g., nonyl-aldehyde, $C_{12}$, $C_{14}$, $C_{16}$, $C_{18}$, $C_{20}$ fatty aldehydes) into fatty alcohols, which can then be converted into wax esters by the wax ester synthase. In certain embodiments, the alcohol dehydrogenase has the amino acid sequence of SEQ ID NO:105 (slr1192; encoded by the polynucleotide sequence of SEQ ID NO:104), or an active fragment or variant of this sequence. In some embodiments, the alcohol dehydrogenase has the amino acid sequence of SEQ ID NO:107 (ACIAD3612; encoded by the polynucleotide sequence of SEQ ID NO:106), or an active fragment or variant of this sequence. Certain of these and related embodiment can be combined with any one or more of reduced expression and/or activity of an endogenous aldehyde dehydrogenase (e.g., orf0489 deletion) to shunt carbon away from fatty acid production, reduced expression and/or activity of an endogenous aldehyde decarbonylase (e.g., orf1593 deletion) to shunt carbon away from alkane production, or both. Also included are combinations that further comprise an introduced or overexpressed acyl carrier protein (ACP), optionally in combination with an introduced or overexpressed acyl-ACP synthetase (Aas).

To produce fatty alcohols, a modified photosynthetic microorganism may comprise an overexpressed acyl-ACP reductase in combination with an introduced or overexpressed alcohol dehydrogenase. These and related embodiments can be further combined with reduced expression and/or activity of an endogenous aldehyde decarbonylase (e.g., orf1593 from *S. elongatus*), reduced expression and/or activity of an endogenous aldehyde dehydrogenase (e.g., orf0489 from *S. elongatus*), or both, to respectively shunt carbon away from alkanes/alkenes and fatty acids and towards fatty alcohols.

To produce alkanes and/or alkenes, a modified photosynthetic microorganism may comprise an overexpressed acyl-ACP reductase in combination with an introduced or overexpressed aldehyde decarbonylase. Exemplary aldehyde decarbonylases include that encoded by orf1593 of *S. elongatus* PCC7942 and its orthologs/paralogs, including those found in *Synechocystis* sp. PCC6803 (encoded by orfsll0208), *N. punctiforme* PCC 73102, *Thermosynechococcus elongatus* BP-1, *Synechococcus* sp. Ja-3-3AB, *P. marinus* MIT9313, *P. marinus* NATL2A, and *Synechococcus* sp. RS 9117, the latter having at least two paralogs (RS 9117-1 and -2). These and related embodiments can be further combined with reduced expression and/or activity of an endogenous aldehyde dehydrogenase (e.g., orf0489 from *S. elongatus*), reduced expression and/or activity of an endogenous alcohol dehydrogenase (e.g., a long-chain alcohol dehydrogenase), or both, to respectively shunt carbon away from fatty acids and fatty alcohols and towards alkanes and/or alkenes.

To produce fatty acids, such as free fatty acids, a modified photosynthetic microorganism may comprise an overexpressed acyl-ACP reductase in optional combination with an introduced or overexpressed aldehyde dehydrogenase (e.g., orf 0489 from *S. elongatus* or orthologs/paralogs/homologs thereof). These and related embodiments can be further combined with reduced expression and/or activity of an aldehyde decarbonylase (e.g., orf1593 from *S. elongatus*), reduced expression and/or activity of an endogenous alcohol dehydrogenase (e.g., long-chain alcohol dehydrogenase), or both, to respectively shunt carbon away from alkanes and fatty alcohols and towards fatty acids. In certain embodiments, such as Cyanobacteria including *S. elongatus* PCC7942, orf1593 resides directly upstream of orf1594 (acyl-ACP reductase coding region) and encodes an aldehyde decarbonylase. According to one non-limiting theory, because the aldehyde decarbonylase encoded by orf1593 utilizes acyl aldehyde as a substrate for alkane production, reducing expression of this protein may further increase yields of free fatty acids by shunting acyl aldehydes (e.g., produced by acyl-ACP reductase) away from an alkane-producing pathway, and towards a fatty acid- or fatty alcohol-producing and storage pathway. PCC7942_orf1593 orthologs can be found, for example, in *Synechocystis* sp. PCC6803 (encoded by orfsll0208), *N. punctiforme* PCC 73102, *Thermosynechococcus elongatus* BP-1, *Synechococcus* sp. Ja-3-3AB, *P. marinus* MIT9313, *P. marinus* NATL2A, and *Synechococcus* sp. RS 9117, the latter having at least two paralogs (RS 9117-1 and -2). Included are strains having mutations or full or partial deletions of one or more genes encoding these and other aldehyde decarbonylases, such as *S. elongatus* PCC7942 having a full or partial deletion of orf1593, and *Synechocystis* sp. PCC6803 having a full or partial deletion of orfsll0208). For instance, an exemplary modified photosynthetic microorganism could comprise an overexpressed acyl-ACP reductase, combined with a full or partial deletion of the glgC gene, the glgA gene, and/or the pgm gene, optionally combined with an overexpressed aldehyde dehydrogenase, and optionally combined with a full or partial deletion of a gene encoding an aldehyde decarbonylase (e.g., PCC7942_orf1593, PCC6803_orfsll0208).

Other combinations include, for example, a modified photosynthetic microorganism comprising reduced LHP accumulation, in combination with one more of an overexpressed ACP; an overexpressed acyl-ACP reductase in combination with an overexpressed ACP; an overexpressed acyl-ACP reductase in combination with an overexpressed ACCase; an overexpressed acyl-ACP reductase in combination with an overexpressed ACP and an overexpressed ACCase; an overexpressed acyl-ACP reductase in combination with an overexpressed DGAT and optionally an overexpressed acyl-CoA synthetase (e.g., a DGAT/acyl-CoA synthetase combination); an overexpressed acyl-ACP reductase with an overexpressed ACP and an overexpressed DGAT, optionally combined with an overexpressed acyl-CoA synthetase; an overexpressed acyl-ACP reductase with an overexpressed ACCase and an overexpressed DGAT, optionally in combination with an overexpressed acyl-CoA synthetase; and an overexpressed acyl-ACP reductase with an overexpressed ACP, overexpressed ACCase, and an overexpressed DGAT, optionally in combination with an overexpressed acyl-CoA synthetase. Acyl-ACP reductase and DGAT-overexpressing strains, optionally in combination with an overexpressed acyl-CoA synthetase, typically produce increased triglycerides relative to DGAT-only overexpressing strains.

Any one of these embodiments can also be combined with a strain having reduced expression of an acyl-ACP synthetase (Aas). Without wishing to be bound by any one theory, an endogenous aldehyde dehydrogenase is acting on the acyl-aldehydes generated by orf1594 and converting them to free fatty acids. The normal role of such a dehydrogenase might involve removing or otherwise dealing with damaged lipids. In this scenario, it is then likely that the Aas gene product recycles these free fatty acids by ligating them to ACP. Accordingly, reducing or eliminating expression of the Aas gene product might ultimately increase production of fatty acids and thus optionally triglycerides (e.g., in a DGAT-expressing microorganism), by reducing or preventing their transfer to ACP. Included are mutations and full or partial deletions of one or more Aas genes, such as the Aas gene of *Synechococcus elongatus* PCC 7942. As one example, a specific modified photosynthetic microorganism could comprise an overexpressed acyl-ACP reductase, combined with a full or partial deletion of the glgC gene, the glgA gene, and/or the pgm gene, optionally combined with an overexpressed ACP, ACCase, DGAT/acyl-CoA synthetase, or all of the foregoing, optionally combined with a full or partial deletion of a gene encoding an aldehyde decarbonylase (e.g., PCC7942_orf1593, PCC6803_orfsll0208), and optionally combined with a full or partial deletion of an Aas gene encoding an acyl-ACP synthetase.

Certain embodiments of the systems and methods of the present disclosure utilize modified photosynthetic organisms with reduced LHP accumulation that are further modified to allow production of isobutanol or isopentanol. In particular embodiments, these organisms comprise one or more introduced or overexpressed polynucleotides that encode a polypeptide associated with isobutanol or isopentanol production. Examples of such polynucleotides include the genes required to convert a 2-keto acid to an aldehyde (2-keto acid decarboxylase) and then convert the aldehyde to an alcohol (alcohol dehydrogenase) in *Synechococcus elongatus*, according to Atsumi and Liao 2007 *Nature* and 2009 *Nature Biotech*. Expression of these genes, or functional fragments or variants thereof, should allow for the production of isobutanol or isopentanol (3-methyl-1-butanol). In certain embodiments, these genes are Alpha-ketoisovalerate decarboxylase (2-keto acid decarboxylase) from *Lactococcus lactis* (kivd) and Alcohol dehydrogenase from *E. coli* (YqhD). The polynucleotide sequence of Alpha-ketoisovalerate decarboxylase (2-keto acid decarboxylase) from *Lactococcus lactis* is set forth in SEQ ID NO:180, and its encoded polypeptide sequence is set forth in SEQ ID NO:181. The polynucleotide sequence of alcohol dehydrogenase from *E. coli* (YqhD) is set forth in SEQ ID NO:182, and its encoded polypeptide sequence is set forth in SEQ ID NO:183.

In additional related embodiments, the modified photosynthetic organism with reduced LHP accumulation are further modified to include one or more introduced or overexpressed polynucleotides involved in converting pyruvate to the precursors for isobutanol or isopentanol production. Thus, they may also be used in combination with any of the related modifications described above. Examples of such polynucleotides and encoded polypeptides include, acetolactate synthase (e.g., *Synechococcus elongatus* PCC7942 ilvN (NCBI YP_401451; SEQ ID NO:184)), acetolactate synthase (e.g., *Synechococcus elongatus* PCC7942 ilvB (NCBI YP_399158; SEQ ID NO:185)), ketol-acid reductoisomerase (e.g., *Synechococcus elongatus* PCC7942 ilvC (NCBI YP_400569; SEQ ID NO:186), dihydroxy-acid dehydratase (e.g., *Synechococcus elongatus* PCC7942 ilvD (NCBI YP_399645; SEQ ID NO:187)), 2-isopropylmalate synthase (e.g., *Synechococcus elongatus* PCC7942 leuA1 (NCBI YP_399447; SEQ ID NO: 188)); 2-isopropylmalate synthase (e.g., *Synechococcus elongatus*

PCC7942 leuA2 (NCBI YP_400427; SEQ ID NO: 189)), isopropylmalate dehydratase (e.g., *Synechococcus elongatus* PCC7942 leuD (NCBIYP_401565; SEQ ID NO:190)), isopropylmalate dehydratase (e.g., *Synechococcus elongatus* PCC7942 leuC (NCBI YP_400915; SEQ ID NO:191)), 3-isopropylmalate dehydrogenase (e.g., *Synechococcus elongatus* PCC7942 leuB (NCBI YP_400522; SEQ ID NO:192); acetolactate synthase (e.g., *Bacillus subtilis* 168 alsS (NCBI NP_391482; SEQ ID NO:193)); ketol-acid reductoisomerase, NAD(P)-binding (e.g., *E. coli* K-12, MG1655 ilvC (NCBI NP_418222; SEQ ID NO:194)); and dihydroxyacid dehydratase (e.g., *E. coli* K-12, MG1655 ilvD (NCBI_YP_026248; SEQ ID NO:195)) and functional fragments and variants thereof.

In additional embodiments, the modified photosynthetic organism with reduced LHP accumulation are further modified to include one or more introduced or overexpressed polynucleotides involved in glucose secretion, in order to allow for continued secretion of glucose from LHP deficient strains that are placed under stress conditions. Examples of such polynucleotides and encoded polypeptides are glucose permeases and glucose/H+ symporters, such as glcP (e.g., *Bacillus subtilis* 168 glcP; NCBI NP_388933; SEQ ID NO:176), glcP1 (e.g., *Streptomyces coelicolor* glcP1; NCBI NP_629713.1; SEQ ID NO:177), glcP2 (e.g., *Streptomyces coelicolor* A3 glcP2; NCBI NP_631212; SEQ ID NO:178), and *Mycobacterium smegmatis* MC2 155 (NCBI YP_888461; SEQ ID NO:179), and functional fragments and variants thereof.

Certain embodiments of the systems and methods of the present disclosure utilize modified photosynthetic organisms with reduced LHP accumulation that are further modified to allow production of 4-hydroxybutyrate. In particular embodiments, these photosynthetic organisms comprise one or more introduced or overexpressed polynucleotides that encode a polypeptide associated with 4-hydroxybutyrate production. Examples of such polynucleotides include the genes required to convert 2-oxogluturate into succinate semialdehyde, and then convert the latter into 4-hydroxybutyrate. In particular embodiments, an alpha-ketoglutarate decarboxylase converts 2-oxogluturate into succinate semialdehyde and a 4-hydroxybutyrate dehydrogenase converts succinate semialdehyde into 4-hydroxybutyrate. Additional examples of such polynucleotides include the genes required to convert succinate into succinyl-CoA, convert succinyl-CoA into succinate semialdehyde, and then conver the latter into 4-hydroxybutyrate. In particular embodiments, a succinyl-CoA synthetase converts succinate into succinyl-CoA, a succinate-semialdehyde dehydrogenase converts succinyl-CoA into succinate semialdehyde, and a 4-hydroxybutyrate dehydrogenase converts succinate semialdehyde into 4-hydroxybutyrate. Specific examples of alpha-ketoglutarate decarboxylases include those encoded by CCDC5180_0513 (SEQ ID NO:211) from *Mycobacterium bovis* and SYNPCC7002_A2770 (SEQ ID NO:212) from *Synechococcus* sp PCC 7002. Specific examples of 4-hydroxybutyrate dehydrogenases include those encoded by PGN_0724 (SEQ ID NO:213) from *Porphyromonas gingivalis* and CKR_2662 (SEQ ID NO:214) from *Clostridium kluyveri*. Specific examples of succinyl-CoA synthetases include the succinyl-CoA synthetase-alpha subunit encoded by sucC (b0728) (SEQ ID NO:218) from *E. coli* and the succinyl-CoA synthetase-beta subunit encoded by sucD (b0729) (SEQ ID NO:219) from *E. coli*. Specific examples of succinate-semialdehyde dehydrogenases include that encoded by PGTDC60_1813 (SEQ ID NO:220) from *Porphyromonas gingivalis*. Expression of certain combinations of these or related genes, or functional fragments or variants thereof, should allow for the production of 4-hydroxybutyrate from 2-oxogluturate or succinate.

Certain embodiments of the systems and methods of the present disclosure utilize modified photosynthetic organisms with reduced LHP accumulation that are further modified to allow production of 4-hydroxybutyrate and optionally 1,4-butanediol. In some embodiments, and further to the polypeptides associated with the production of 4-hydroxybutyrate (supra), these microorganisms comprise one or more introduced or overexpressed polynucleotides that encode a polypeptide associated with the production of 1,4-butanediol from 4-hydroxybutyrate. Examples of such polynucleotides include the genes required to convert 4-hydroxybutyrate into 4-hydroxybutyryl-CoA, then convert 4-hydroxybutyryl-CoA into 4-hydroxybutyraldehyde, and then convert 4-hydroxybutyraldehyde into 1,4-butanediol. In particular embodiments, a 4-hydroxybutyryl-CoA transferase converts 4-hydroxybutyrate into 4-hydroxybutyryl-CoA, an aldehyde/alcohol dehydrogenase converts 4-hydroxybutyryl-CoA into 4-hydroxybutyraldehyde (e.g., one that is capable of reducing coA-linked substrates to aldehydes/alcohols), and an aldehyde/alcohol dehydrogenase converts 4-hydroxybutyraldehyde into 1,4-butanediol. Specific examples of 4-hydroxybutyryl-CoA transferases include that encoded by cat2 (CKR_2666) (SEQ ID NO:215) from *Clostridium kluyveri*, including homologs from *Clostridium aminobutyricum* and *Porphyromonas gingivalis*. Specific examples of aldehyde/alcohol dehydrogenases include those encoded by adhE2 (CEA_P0034) (SEQ ID NO:216) from *Clostridium acetobutylicum* and adhE (b1241) (SEQ ID NO:217) from *E. coli*. Expression of certain combinations of these or related genes, or functional fragments or variants thereof, should allow for the production of 4-hydroxybutyrate from 2-oxogluturate or succinate, and the production of 1,4-butanediol from 4-hydroxybutyrate.

Particular embodiments of the systems and methods of the present disclosure utilize modified photosynthetic organisms with reduced LHP accumulation that are further modified to allow production of polyamine intermediates/precursors. Exemplary polyamine intermediates include agmatine and putrescine. The systems and methods described herein can produce increased agmatine and putrescine without any further modifications. However, in particular embodiments, to further increase production these microorganisms may comprise one or more introduced or overexpressed polynucleotides that encode a polypeptide associated with polyamine intermediate production. Examples of such polynucleotides include the genes required to convert L-arginine into agmatine, and optionally the genes required to convert agmatine into N-carbamoylputrescine, and then convert N-carbamoylputrescine into putrescine. In some embodiments, an arginine decarboxylase is introduced or overexpressed to convert L-arginine into agmatine. In particular embodiments, an agmatine deiminase is introduced or overexpressed to convert agmatine into N-carbamoylputrescine, and/or a N-carbamoylputrescine amidase is introduced or overexpressed to convert N-carbamoylputrescine into putrescine. Specific examples of arginine decarboxylases include that encoded by Synpcc7942_1037 (SEQ ID NO:221) from *S. elongatus* PCC7942. Specific examples of agmatine deiminases include that encoded by Synpcc7942_2402 (SEQ ID NO:222) and Synpcc7942_2461 from *S. elongatus* PCC7942. Specific examples of N-carbamoylputrescine amidases include that encoded by Synpcc7942_2145 (SEQ ID NO:223) from *S. elongatus* PCC7942. Introduction or overexpression of certain combinations of these or related genes, or functional fragments or variants thereof, should allow for the increased production of agmatine, putrescine, or both.

Increased expression can be achieved a variety of ways, for example, by introducing a polynucleotide into the photosynthetic organism, modifying an endogenous gene to overexpress the polypeptide, or both. For instance, one or more copies of an otherwise endogenous polynucleotide sequence can be introduced by recombinant techniques to increase expression, and/or a promoter/enhancer sequence can be introduced upstream of an endogenous gene to regulate expression.

Modified photosynthetic organisms of the present disclosure may be produced, for example, using any type of photosynthetic microorganism. These include, but are not limited to photosynthetic bacteria, green algae, and Cyanobacteria. The photosynthetic microorganism can be, for example, a naturally photosynthetic microorganism, such as a Cyanobacterium, or an engineered photosynthetic microorganism, such as an artificially photosynthetic bacterium. Exemplary microorganisms that are either naturally photosynthetic or can be engineered to be photosynthetic include, but are not limited to, bacteria; fungi; archaea; protists; eukaryotes, such as a green algae; and animals such as plankton, planarian, and amoeba. Examples of naturally occurring photosynthetic microorganisms include, but are not limited to, *Spirulina maximum, Spirulina platensis, Dunaliella salina, Botrycoccus braunii, Chlorella vulgaris, Chlorella pyrenoidosa, Serenastrum capricornutum, Scenedesmus auadricauda, Porphyridium cruentum, Scenedesmus acutus, Dunaliella* sp., *Scenedesmus obliquus, Anabaenopsis, Aulosira, Cylindrospermum, Synechococcus* sp., *Synechocystis* sp., and/or *Tolypothrix*.

A modified Cyanobacteria of the present disclosure may be from any genera or species of Cyanobacteria that is genetically manipulable, i.e., permissible to the introduction and expression of exogenous genetic material. Examples of Cyanobacteria that can be engineered according to the methods of the present disclosure include, but are not limited to, the genus *Synechocystis, Synechococcus*, Thermosynechococcus, *Nostoc*, Prochlorococcu, Microcystis, *Anabaena, Spirulina*, and *Gloeobacter*.

Cyanobacteria, also known as blue-green algae, blue-green bacteria, or Cyanophyta, is a phylum of bacteria that obtain their energy through photosynthesis. Cyanobacteria can produce metabolites, such as carbohydrates, proteins, lipids and nucleic acids, from $CO_2$, water, inorganic salts and light. Any Cyanobacteria may be used according to the present disclosure.

Cyanobacteria include both unicellular and colonial species. Colonies may form filaments, sheets or even hollow balls. Some filamentous colonies show the ability to differentiate into several different cell types, such as vegetative cells, the normal, photosynthetic cells that are formed under favorable growing conditions; akinetes, the climate-resistant spores that may form when environmental conditions become harsh; and thick-walled heterocysts, which contain the enzyme nitrogenase, vital for nitrogen fixation.

Heterocysts may also form under the appropriate environmental conditions (e.g., anoxic) whenever nitrogen is necessary. Heterocyst-forming species are specialized for nitrogen fixation and are able to fix nitrogen gas, which cannot be used by plants, into ammonia ($NH_3$), nitrites ($NO_2^-$), or nitrates ($NO_3^-$), which can be absorbed by plants and converted to protein and nucleic acids.

Many Cyanobacteria also form motile filaments, called hormogonia, which travel away from the main biomass to bud and form new colonies elsewhere. The cells in a hormogonium are often thinner than in the vegetative state, and the cells on either end of the motile chain may be tapered. In order to break away from the parent colony, a hormogonium often must tear apart a weaker cell in a filament, called a necridium.

Each individual Cyanobacterial cell typically has a thick, gelatinous cell wall. Cyanobacteria differ from other gram-negative bacteria in that the quorum sensing molecules autoinducer-2 and acyl-homoserine lactones are absent. They lack flagella, but hormogonia and some unicellular species may move about by gliding along surfaces. In water columns, some Cyanobacteria float by forming gas vesicles, like in archaea.

Cyanobacteria have an elaborate and highly organized system of internal membranes that function in photosynthesis. Photosynthesis in Cyanobacteria generally uses water as an electron donor and produces oxygen as a by-product, though some Cyanobacteria may also use hydrogen sulfide, similar to other photosynthetic bacteria. Carbon dioxide is reduced to form carbohydrates via the Calvin cycle. In most forms, the photosynthetic machinery is embedded into folds of the cell membrane, called thylakoids. Due to their ability to fix nitrogen in aerobic conditions, Cyanobacteria are often found as symbionts with a number of other groups of microorganisms such as fungi (e.g., lichens), corals, pteridophytes (e.g., *Azolla*), and angiosperms (e.g., *Gunnera*), among others.

Cyanobacteria are the only group of microorganisms that are able to reduce nitrogen and carbon in aerobic conditions. The water-oxidizing photosynthesis is accomplished by coupling the activity of photosystem (PS) II and I (Z-scheme). In anaerobic conditions, Cyanobacteria are also able to use only PS I (i.e., cyclic photophosphorylation) with electron donors other than water (e.g., hydrogen sulfide, thiosulphate, or molecular hydrogen), similar to purple photosynthetic bacteria. Furthermore, Cyanobacteria share an archaeal property; the ability to reduce elemental sulfur by anaerobic respiration in the dark. The Cyanobacterial photosynthetic electron transport system shares the same compartment as the components of respiratory electron transport. Typically, the plasma membrane contains only components of the respiratory chain, while the thylakoid membrane hosts both respiratory and photosynthetic electron transport.

Phycobilisomes, attached to the thylakoid membrane, act as light harvesting proteins (e.g. antennae) for the photosystems of Cyanobacteria. The phycobilisome components (phycobiliproteins) are responsible for the blue-green pigmentation of most Cyanobacteria. Color variations are mainly due to carotenoids and phycoerythrins, which may provide the cells with a red-brownish coloration. In some Cyanobacteria, the color of light influences the composition of phycobilisomes. In green light, the cells accumulate more phycoerythrin, whereas in red light they produce more phycocyanin. Thus, the bacteria appear green in red light and red in green light. This process is known as complementary chromatic adaptation and represents a way for the cells to maximize the use of available light for photosynthesis.

In particular embodiments, the Cyanobacteria may be, e.g., a marine form of Cyanobacteria or a freshwater form of Cyanobacteria. Examples of marine forms of Cyanobacteria include, but are not limited to *Synechococcus* WH8102, *Synechococcus* RCC307, *Synechococcus* NKBG 15041c, and *Trichodesmium*. Examples of freshwater forms of Cyanobacteria include, but are not limited to, *S. elongatus* PCC7942, *Synechocystis* PCC6803, *Plectonema boryanum*, and *Anabaena* sp. Exogenous genetic material encoding the desired enzymes or polypeptides may be introduced either transiently, such as in certain self-replicating vectors, or stably, such as by integration (e.g., recombination) into the Cyanobacterium's native genome.

In other embodiments, a genetically modified Cyanobacteria of the present disclosure may be capable of growing in brackish or salt water. When using a freshwater form of Cyanobacteria, the overall net cost for production of triglycerides will depend on both the nutrients required to grow the culture and the price for freshwater. One can foresee freshwater being a limited resource in the future, and in that case it would be more cost effective to find an alternative to freshwater. Two such alternatives include: (1) the use of waste water from treatment plants; and (2) the use of salt or brackish water.

Salt water in the oceans can range in salinity between 3.1% and 3.8%, the average being 3.5%, and this is mostly, but not entirely, made up of sodium chloride (NaCl) ions. Brackish water, on the other hand, has more salinity than freshwater, but not as much as seawater. Brackish water contains between 0.5% and 3% salinity, and thus includes a large range of salinity regimes and is therefore not precisely defined. Waste water is any water that has undergone human influence. It consists of liquid waste released from domestic and commercial properties, industry, and/or agriculture and can encompass a wild range of possible contaminants at varying concentrations.

There is a broad distribution of Cyanobacteria in the oceans, with *Synechococcus* filling just one niche. Specifically, *Synechococcus* sp. PCC 7002 (formerly known as *Agmenellum quadruplicatum* strain PR-6) grows in brackish water, is unicellular and has an optimal growing temperature of 38° C. While this strain is well suited to grow in conditions of high salt, it will grow slowly in freshwater. In particular embodiments, the present disclosure contemplates the use of a Cyanobacteria *S. elongatus* PCC7942, altered in a way that allows for growth in either waste water or salt/brackish water. A *S. elongatus* PCC7942 mutant resistant to sodium chloride stress has been described (Bagchi, S. N. et al., Photosynth Res. 2007, 92:87-101), and a genetically modified *S. elongatus* PCC7942 tolerant of growth in salt water has been described (Waditee, R. et al., PNAS 2002, 99:4109-4114). According to the present disclosure, a salt water tolerant strain is capable of growing in water or media having a salinity in the range of 0.5% to 4.0% salinity, although it is not necessarily capable of growing in all salinities encompassed by this range. In one embodiment, a salt tolerant strain is capable of growth in water or media having a salinity in the range of 1.0% to 2.0% salinity. In another embodiment, a salt water tolerant strain is capable of growth in water or media having a salinity in the range of 2.0% to 3.0% salinity.

Examples of Cyanobacteria that may be utilized and/or genetically modified according to the methods described herein include, but are not limited to, *Chroococcales* Cyanobacteria from the genera *Aphanocapsa, Aphanothece, Chamaesiphon, Chroococcus, Chroogloeocystis, Coelosphaerium, Crocosphaera, Cyanobacterium, Cyanobium, Cyanodictyon, Cyanosarcina, Cyanothece, Dactylococcopsis, Gloeocapsa, Gloeothece, Merismopedia, Microcystis, Radiocystis, Rhabdoderma, Snowella, Synychococcus, Synechocystis, Thermosenechococcus*, and *Woronichinia; Nostocales* Cyanobacteria from the genera *Anabaena, Anabaenopsis, Aphanizomenon, Aulosira, Calothrix, Coleodesmium, Cyanospira, Cylindrospermosis, Cylindrospermum, Fremyella, Gleotrichia, Microchaete, Nodularia, Nostoc, Rexia, Richelia, Scytonema, Sprirestis,* and *Toypothrix; Oscillatoriales* Cyanobacteria from the genera *Arthrospira, Geitlerinema, Halomicronema, Halospirulina, Katagnymene, Leptolyngbya, Limnothrix, Lyngbya, Microcoleus, Oscillatoria, Phormidium, Planktothricoides, Planktothrix, Plectonema, Pseudoanabaena/Limnothrix, Schizothrix, Spirulina, Symploca, Trichodesmium, Tychonema; Pleurocapsales* cyanobacterium from the genera *Chroococcidiopsis, Dermocarpa, Dermocarpella, Myxosarcina, Pleurocapsa, Stanieria, Xenococcus; Prochlorophytes* Cyanobacterium from the genera *Prochloron, Prochlorococcus, Prochlorothrix;* and *Stigonematales* cyanobacterium from the genera *Capsosira, Chlorogeoepsis, Fischerella, Hapalosiphon, Mastigocladopsis, Nostochopsis, Stigonema, Symphyonema, Symphonemopsis, Umezakia,* and *Westiellopsis*. In certain embodiments, the Cyanobacterium is from the genus *Synechococcus*, including, but not limited to *Synechococcus bigranulatus, Synechococcus elongatus, Synechococcus leopoliensis, Synechococcus lividus, Synechococcus nidulans,* and *Synechococcus rubescens*.

In certain embodiments, the Cyanobacterium is *Anabaena* sp. strain PCC 7120, *Synechocystis* sp. strain PCC6803, *Nostoc muscorum, Nostoc ellipsosporum,* or *Nostoc* sp. strain PCC 7120. In certain preferred embodiments, the Cyanobacterium is *S. elongatus* sp. strain PCC7942.

Additional examples of Cyanobacteria that may be utilized in the methods provided herein include, but are not limited to, *Synechococcus* sp. strains WH7803, WH8102, WH8103 (typically genetically modified by conjugation), Baeocyte-forming *Chroococcidiopsis* spp. (typically modified by conjugation/electroporation), non-heterocyst-forming filamentous strains *Planktothrix* sp., *Plectonema boryanum* M101 (typically modified by electroporation), and Heterocyst-forming strains *Anabaena* sp. strains ATCC 29413 (typically modified by conjugation), *Tolypothrix* sp. strain PCC 7601 (typically modified by conjugation/electroporation) and *Nostoc punctiforme* strain ATCC 29133 (typically modified by conjugation/electroporation).

In certain preferred embodiments, the Cyanobacterium may be *S. elongatus* sp. strain PCC7942 or *Synechococcus* sp. PCC 7002 (originally known as *Agmenellum quadruplicatum*).

In particular embodiments, the genetically modified, photosynthetic microorganism, e.g., Cyanobacteria, of the present disclosure may be used to produce triglycerides and/or other carbon-containing compounds from just sunlight, water, air, and minimal nutrients, using routine culture techniques of any reasonably desired scale. In particular embodiments, the present disclosure contemplates using spontaneous mutants of photosynthetic microorganisms that demonstrate a growth advantage under a defined growth condition. Among other benefits, the ability to produce large amounts of triglycerides from minimal energy and nutrient input makes the modified photosynthetic microorganism, e.g., Cyanobacteria, of the present disclosure a readily manageable and efficient source of feedstock in the subsequent production of biofuels, such as biodiesel, and other specialty chemicals, such as glycerin.

Methods of producing a modified photosynthetic microorganism, e.g., a Cyanobacterium, that has a reduced light harvesting protein production as compared to a wild-type photosynthetic microorganism, which may be used in the systems or methods of the present disclosure, include modifying the photosynthetic microorganism so that it has a reduced level of expression of one or more genes of the light harvesting protein production. In certain embodiments, the one or more genes include nblA, rpaB, pbsB, pbsC, Phycobiliprotein gene or a combination thereof. In particular embodiments, expression or activity is reduced by mutating or deleting a portion or all of the one or more genes. In particular embodiments, expression or activity is reduced by knocking out or knocking down one or more alleles of the one or more genes. In particular embodiments, expression or activity of the one or more genes is reduced by contacting the photosynthetic microorganism with an antisense oligonucleotide or interfering RNA, e.g., an siRNA, that targets the one or more genes. In particular embodiments, a vector that expresses a polynucleotide that hybridizes to the one or more genes, e.g., an antisense oligonucleotide or an siRNA is introduced into the photosynthetic microorganism.

In certain embodiments, the method comprises modifying one or more polynucleotides associated with a light harvesting protein (LHP) of Cyanobacteria to generate the modified Cyanobacteria, wherein the modified cyanobacteria have an increased level of photosynthetic activity as compared to corresponding wild-type Cyanobacteria. In these embodiments and other embodiments, the method comprises culturing Cyanobacteria under a stress condition; and isolating modified Cyanobacteria that have an increased level of photosynthetic activity as compared to corresponding wild-type Cyanobacteria, wherein the stress condition comprises culturing under increased light, culturing in metronidazole containing growth media or both.

In some embodiments, the photosynthetic activity of the Cyanobacteria is greater than photosynthetic activity of the corresponding wild-type Cyanobacteria. In certain embodiments, the photosynthetic activity is measured based on at least one of a growth rate, a level of oxygen evolution, or a biomass accumulation rate. In particular embodiments, the growth rate of the modified Cyanobacteria is at least about 110% of a growth rate of the corresponding wild-type Cyanobacteria. In particular embodiments, the growth rate of the modified Cyanobacteria is at least about 120% of a growth rate of the corresponding wild-type Cyanobacteria. In particular embodiments, the growth rate of the modified Cyanobacteria is at least about 1.5, 2, 3, 4, 5, 6, 7, 8, 9, 10 or 20-fold greater than a growth rate of the corresponding wild-type Cyanobacteria. In particular embodiments, the growth rate is measured at about day 2, 3, 4, 5, 6, 7, 8, 9, 10, 11, 12, 13, or 14 post-initiation of culturing.

In certain embodiments, the level of oxygen evolution of the modified Cyanobacteria is at least about 110% of a level of oxygen evolution of the corresponding wild-type Cyanobacteria. In particular embodiments, the level of oxygen evolution of the modified Cyanobacteria is at least about 120% of a level of oxygen evolution of the corresponding wild-type Cyanobacteria. In particular embodiments, the level of oxygen evolution of the modified Cyanobacteria is at least about 1.5, 2, 3, 4, 5, 6, 7, 8, 9, 10 or 20-fold greater than a level of oxygen evolution of the corresponding wild-type Cyanobacteria. In particular embodiments, the level of oxygen evolution is measured at about day 2, 3, 4, 5, 6, 7, 8, 9, 10, 11, 12, 13, or 14 post-initiation of culturing.

In certain embodiments, the biomass accumulation rate of the modified Cyanobacteria is at least about 110% of a biomass accumulation rate of the corresponding wild-type Cyanobacteria. In particular embodiments, the biomass accumulation rate of the modified Cyanobacteria is at least about 120% of a level of biomass accumulation of the corresponding wild-type Cyanobacteria. In particular embodiments, the biomass accumulation rate of the modified Cyanobacteria is at least about 1.5, 2, 3, 4, 5, 6, 7, 8, 9, 10 or 20-fold greater than a biomass accumulation rate of the corresponding wild-type Cyanobacteria. In particular embodiments, the biomass accumulation rate is measured at about day 2, 3, 4, 5, 6, 7, 8, 9, 10, 11, 12, 13, or 14 post-initiation of culturing.

Photosynthetic microorganisms, e.g., Cyanobacteria may be genetically modified according to techniques known in the art, e.g., to delete a portion or all of a gene or to introduce a polynucleotide that expresses a functional polypeptide. As noted above, in certain aspects, genetic manipulation in photosynthetic microorganisms, e.g., Cyanobacteria, can be performed by the introduction of non-replicating vectors which contain native photosynthetic microorganism sequences, exogenous genes of interest, and selectable markers or drug resistance genes. Upon introduction into the photosynthetic microorganism, the vectors may be integrated into the photosynthetic microorganism's genome through homologous recombination. In this way, an exogenous gene of interest and the drug resistance gene are stably integrated into the photosynthetic microorganism's genome. Such recombinants cells can then be isolated from non-recombinant cells by drug selection. Cell transformation methods and selectable markers for Cyanobacteria are also well known in the art (see, e.g., Wirth, *Mol Gen Genet* 216:175-7, 1989; and Koksharova, *Appl Microbiol Biotechnol* 58:123-37, 2002; and THE CYANOBACTERIA: MOLECULAR BIOLOGY, GENETICS, AND EVOLUTION (eds. Antonio Herrera and Enrique Flores) Caister Academic Press, 2008, each of which is incorporated by reference for their description on gene transfer into Cyanobacteria, and other information on Cyanobacteria).

Generation of deletions or mutations of any of the one or more genes associated with the light harvesting protein production or lipid biosynthesis can be accomplished according to a variety of methods known in the art, including those described and exemplified herein. For instance, the instant application describes the use of a non-replicating, selectable vector system that is targeted to the upstream and downstream flanking regions of a given gene (e.g., nblA, rpaB), and which recombines with the Cyanobacterial genome at those flanking regions to replace the endogenous coding sequence with the vector sequence. Given the presence of a selectable marker in the vector sequence, such as a drug selectable marker, Cyanobacterial cells containing the gene deletion can be readily isolated, identified and characterized. Such selectable vector-based recombination methods need not be limited to targeting upstream and downstream flanking regions, but may also be targeted to internal sequences within a given gene, as long as that gene is rendered "non-functional," as described herein.

The generation of deletions or mutations can also be accomplished using antisense-based technology. For instance, Cyanobacteria have been shown to contain natural regulatory events that rely on antisense regulation, such as a 177-nt ncRNA that is transcribed in antisense to the central portion of an iron-regulated transcript and blocks its accumulation through extensive base pairing (see, e.g., Dühring, et al., *Proc. Natl. Acad. Sci. USA* 103:7054-7058, 2006), as well as a alr1690 mRNA that overlaps with, and is complementary to, the complete furA gene, which acts as an antisense RNA (α-furA RNA) interfering with furA transcript translation (see, e.g., Hernandez et al., *Journal of Molecular Biology* 355:325-334, 2006). Thus, the incorporation of antisense molecules targeted to genes involved in the light harvesting protein production or lipid biosynthesis would be similarly expected to negatively regulate the expression of these genes, rendering them "non-functional," as described herein.

As used herein, antisense molecules encompass both single and double-stranded polynucleotides comprising a strand having a sequence that is complementary to a target coding strand of a gene or mRNA. Thus, antisense molecules include both single-stranded antisense oligonucleotides and double-stranded siRNA molecules.

In certain aspects, modified photosynthetic microorganisms, e.g., Cyanobacteria, that may be used in the systems and methods of the present disclosure may be prepared by: (i) modifying a photosynthetic microorganism so that it expresses a reduced amount of one or more genes associated with the light harvesting protein production or storage pathway and/or expresses an increased amount of one or more polynucleotides encoding a polypeptide associated with the light harvesting protein breakdown pathway or secretion of the light harvesting protein precursor; and (ii) introducing into the photosynthetic microorganism one or more polynucleotides encoding one or more enzymes associated with lipid biosynthesis, secretion of glucose, isobutanol and/or isopentanol biosynthesis, 4-hydroxybutyrate and/or 1,4-butanediol biosynthesis, or polyamine intermediate biosynthesis, as described elsewhere herein, and/or (iii) introducing into the photosynthetic microorganism one or more polynucleotide regulatory elements (e.g., promoters, enhancers) that increase or otherwise regulate expression of one or more endogenous enzymes associated with lipid biosynthesis, secretion of glucose, isobutanol and/or isopentanol biosynthesis, 4-hydroxybutyrate and/or 1,4-butanediol biosynthesis, or polyamine intermediate biosynthesis; and/or (iv) modifying a photosynthetic microorganism so that it expresses a reduced amount and/or a reduced-function mutant of one or more selected genes/polypeptides associated with lipid biosynthesis, as described herein. The methods may further comprise a step of: (v) selecting for photosynthetic microorganisms in which the one or more desired polynucleotides were successfully introduced, where the polynucleotides were, e.g., present in a vector that expressed a selectable marker, such as an antibiotic resistance gene. As one example, selection and isolation may include the use of antibiotic resistant markers known in the art (e.g., kanamycin, spectinomycin, and streptomycin).

Other modifications described herein may be produced using standard procedures and reagents, e.g., vectors, available in the art. Related methods are described in PCT Application No. WO 2010/075440, which is hereby incorporated by reference in its entirety.

The photosynthetic microorganisms and methods of the present disclosure may be used to produce lipids, such as fatty acids, triglycerides, alkanes/alkenes, fatty alcohols, and/or wax esters. Accordingly, the present disclosure provides methods of producing lipids comprising culturing any of the modified photosynthetic microorganisms described herein wherein the modified photosynthetic microorganism produces, secretes and/or accumulates (e.g., stores,) an increased amount of cellular lipid as compared to a corresponding wild-type or unmodified photosynthetic microorganism.

In one embodiment, the modified photosynthetic microorganism is a Cyanobacterium that produces or accumulates increased fatty acids relative to an unmodified or wild-type Cyanobacterium of the same species. In certain embodiments, the modified photosynthetic microorganism such as Cyanobacteria produces increased levels of particular fatty acids, such as C16:0 fatty acids. In certain embodiments, the modified photosynthetic microorganism is a Cyanobacterium that produces or accumulates increased wax esters relative to an unmodified or wild-type Cyanobacterium of the same species. In particular embodiments, the modified photosynthetic microorganism is a Cyanobacterium that produces or accumulates increased triglycerides relative to an unmodified or wild-type Cyanobacterium of the same species. In some embodiments, the modified photosynthetic microorganism is a Cyanobacterium that produces or accumulates increased alkanes and/or alkenes relative to an unmodified or wild-type Cyanobacterium of the same species.

In certain embodiments, the one or more introduced polynucleotides are present in one or more expression constructs. In particular embodiments, the one or more expression constructs comprises one or more inducible promoters. In certain embodiments, the one or more expression constructs are stably integrated into the genome of the modified photosynthetic microorganism. In certain embodiments, the introduced polynucleotide encoding an introduced protein is present in an expression construct comprising a weak promoter under non-induced conditions. In certain embodiments, one or more of the introduced polynucleotides are codon-optimized for expression in a Cyanobacterium, e.g., a *Synechococcus elongatus*.

In particular embodiments, the photosynthetic microorganism is a *Synechococcus elongatus*, such as *Synechococcus elongatus* strain PCC7942 or a salt tolerant variant of *Synechococcus elongatus* strain PCC7942.

In particular embodiments, the photosynthetic microorganism is a *Synechococcus* sp. PCC 7002 or a *Synechocystis* sp. PCC6803.

In particular embodiments, the modified photosynthetic microorganisms are cultured under conditions suitable for inducing expression of the introduced polynucleotide(s), e.g., wherein the introduced polynucleotide(s) comprise an inducible promoter. Conditions and reagents suitable for inducing inducible promoters are known and available in the art. Also included are the use of auto-inductive systems, for example, where a metabolite represses expression of the introduced polynucleotide, and the use of that metabolite by the microorganism over time decreases its concentration and thus its repressive activities, thereby allowing increased expression of the polynucleotide sequence.

In certain embodiments, modified photosynthetic microorganisms, e.g., Cyanobacteria, are grown under conditions favorable for producing lipids, triglycerides and/or fatty acids. In particular embodiments, light intensity is between 100 and 2000 uE/m2/s, or between 200 and 1000 uE/m2/s. In particular embodiments, the pH range of culture media is between 7.0 and 10.0. In certain embodiments, $CO_2$ is injected into the culture apparatus to a level in the range of 1% to 10%. In particular embodiments, the range of $CO_2$ is between 2.5% and 5%. In certain embodiments, nutrient supplementation is performed during the linear phase of growth. Each of these conditions may be desirable for triglyceride production.

In certain embodiments, the modified photosynthetic microorganisms are cultured, at least for some time, under static growth conditions as opposed to shaking conditions. For example, the modified photosynthetic microorganisms may be cultured under static conditions prior to inducing expression of an introduced polynucleotide (e.g., acyl-ACP reductase, ACP, LHP breakdown protein, ACCase, DGAT, fatty acyl-CoA synthetase, aldehyde dehydrogenase, alcohol dehydrogenase, aldehyde decarbonylase) and/or the modified photosynthetic microorganism may be cultured under static conditions while expression of an introduced polynucleotide is being induced, or during a portion of the time period during which expression of an introduced polynucleotide is being induced. Static growth conditions may be defined, for example, as growth without shaking or growth wherein the cells are shaken at less than or equal to 30 rpm or less than or equal to 50 rpm.

In certain embodiments, the modified photosynthetic microorganisms are cultured, at least for some time, in media supplemented with varying amounts of bicarbonate. For example, the modified photosynthetic microorganisms may be cultured with bicarbonate at 5, 10, 20, 50, 75, 100, 200, 300, 400, 500, 600, 700, 800, 900, 1000 mM bicarbonate prior to inducing expression of an introduced polynucleotide (e.g., acyl-ACP reductase, ACP, LHP breakdown protein, ACCase, DGAT, fatty acyl-CoA synthetase, alcohol dehydrogenase, aldehyde dehydrogenase, aldehyde decarbonylase) and/or the modified photosynthetic microorganism may be cultured with aforementioned bicarbonate concentrations while expression of an introduced polynucleotide is being induced, or during a portion of the time period during which expression of an introduced polynucleotide is being induced.

In related embodiments, modified photosynthetic microorganisms and methods of the present disclosure may be used in the production of a biofuel or other specialty chemical. Thus, in particular embodiments, a method of producing a biofuel comprises culturing any of the modified photosynthetic microorganisms of the present disclosure under conditions wherein the modified photosynthetic microorganism accumulates an increased amount of total cellular lipid (e.g., fatty acid, wax ester, alkane/alkene, fatty alcohol, and/or triglyceride), as compared to a corresponding wild-type photosynthetic microorganism, obtaining the cellular lipid from the microorganism, and processing the obtained cellular lipid to produce a biofuel. In another embodiment, a method of producing a biofuel comprises processing lipids (e.g., fatty acids, wax esters, alkanes/alkenes, fatty alcohols, triglycerides) produced by a modified photosynthetic microorganism of the present disclosure to produce a biofuel. In particular embodiments, the modified photosynthetic microorganism is grown under stress conditions wherein it has reduced growth but maintains photosynthesis.

Methods of processing lipids from microorganisms to produce a biofuel or other specialty chemical, e.g., biodiesel, are known and available in the art. For example, triglycerides may be transesterified to produce biodiesel. Transesterification may be carried out by any one of the methods known in the art, such as alkali-, acid-, or lipase-catalysis (see, e.g., Singh et al. Recent Pat Biotechnol. 2008, 2(2): 130-143). Various methods of transesterification utilize, for example, use of a batch reactor, a supercritical alcohol, an ultrasonic reactor, or microwave irradiation (Such methods are described, for example, in Jeong and Park, *Appl Biochem Biotechnol.* 2006, 131(1-3):668-679; Fukuda et al., *Journal of Bioscience and Engineering.* 2001, 92(5):405-416; Shah and Gupta, *Chemistry Central Journal.* 2008, 2(1):1-9; and Carrillo-Munoz et al., *J Org Chem.* 1996, 61(22):7746-7749). The biodiesel may be further processed or purified, e.g., by distillation, and/or a biodiesel stabilizer may be added to the biodiesel, as described, for example, in U.S. Patent Application Publication No. 2008/0282606.

Polypeptides

Embodiments of the present disclosure include modified photosynthetic microorganisms, such as Cyanobacteria that have modulated the expression level of certain genes involved in light harvesting proteins (LHP) synthesis, such as by mutation or deletion, leads to reduced LHP synthesis and/or storage in the modified photosynthetic microorganisms. For instance, Cyanobacteria, such as *Synechococcus*, which contain modulations of the nblA, rpaB, pbsB, pbsC, or Phycobiliprotein gene, individually or in various combinations, may produce and accumulate significantly reduced levels of LHP as compared to wild-type Cyanobacteria.

Further to including a reduced LHP, the modified photosynthetic microorganisms include diacylglycerol acyltransferase (DGAT) fusion proteins, comprising at least one DGAT polypeptide fused to at least one heterologous intracellular localization domain, such as a bacterial membrane-targeting domain. Such fusion proteins can be partially or fully isolated from other cellular components, or expressed, for example, in cell-free systems or a host cell, such as a modified photosynthetic microorganism.

In certain instances, the modified photosynthetic microorganisms described herein can optionally comprise any combination of one or more overexpressed or introduced lipid biosynthesis proteins and/or one or more overexpressed or introduced proteins associated with glycogen breakdown. Examples of lipid biosynthesis proteins include acyl carrier proteins (ACP), acyl ACP synthases (Aas), acyl-ACP reductases, alcohol dehydrogenases, aldehyde dehydrogenases, aldehyde decarbonylases, thioesterases (TES), acetyl coenzyme A carboxylases (ACCase), phosphatidic acid phosphatases (PAP; or phosphatidate phosphatases), triacylglycerol (TAG) hydrolases, fatty acyl-CoA synthetases, and lipases/phospholipases, as described herein. Exemplary proteins associated with glycogen breakdown are described infra.

In certain instances, photosynthetic microorganisms may optionally comprise reduced, eliminated, or non-functional expression (e.g., expression of a deletion mutant with reduced or no functional activity) of one or more endogenous lipid biosynthesis proteins. In particular aspects, for example, in the production of wax esters, modified photosynthetic microorganisms such as *Synechococcus* may optionally comprise reduced, eliminated, or non-functional expression of one or more aldehyde decarbonylases (e.g., orf1593), aldehyde dehydrogenases (e.g., orf0489), or both. In certain aspects, a modified photosynthetic microorganism may optionally comprise reduced, eliminated, or non-functional expression of an Aas polypeptide.

Any of these modified photosynthetic microorganisms may optionally comprise reduced, eliminated, or non-functional expression of one or more proteins associated with glycogen biosynthesis, either alone or in combination with overexpressed lipid biosynthesis proteins and/or overexpressed glycogen breakdown proteins, or in combination with any other polypeptide-related modification described herein.

As will be apparent, modified photosynthetic microorganisms of the present disclosure may comprise any combination of one or more of the additional modifications noted herein, typically as long as they express at least one intracellular localization domain-DGAT fusion protein. It is further understood that the compositions and methods of the present disclosure may be practiced using biologically active variants and/or fragments of any of the polypeptides described herein.

(i) Intracellular Localization Domain-DGAT Fusion Proteins

As noted above, embodiments of the present disclosure include intracellular localization domain-DGAT "fusion proteins," comprising at least one DGAT polypeptide fused to at least one heterologous intracellular localization domain, such as a bacterial membrane-targeting domain.

"Fusion proteins" are defined elsewhere herein and well known in the art, as are methods of making fusion proteins. Fusion proteins may be prepared using standard techniques. For example, DNA sequences encoding the polypeptide components of a desired fusion may be assembled separately, and ligated into an appropriate expression vector. The 3' end of the DNA sequence encoding one polypeptide component can be ligated, with or without a peptide linker (described below), to the 5' end of a DNA sequence encoding the second (or third, fourth, etc.) polypeptide component so that the reading frames of the sequences are in phase. This permits translation into a single fusion protein that retains the biological activity of both component polypeptides.

The ligated DNA sequences may be operably linked to suitable transcriptional or translational regulatory elements. The regulatory elements responsible for expression of DNA are typically located 5' to the DNA sequence encoding the first polypeptide (e.g., the membrane-targeting domain). Similarly, stop codons required to end translation and transcription termination signals are typically present 3' to the DNA sequence encoding the second (or third, fourth, etc.) polypeptide.

In the DGAT fusion proteins described herein, the intracellular localization or targeting domain can be fused to the N-terminus of the DGAT polypeptide, the C-terminus of the DGAT polypeptide, internally, or any combination thereof. For internal fusions, the intracellular localization or targeting domain can be fused to the DGAT polypeptide within the N-terminal region (e.g., within about the first 2, 3, 4, 5, 6, 7, 8, 9, 10, 20, 30, 40, 50, 60, 70, 80, 90, 100 or so amino acids), at an internal region (between the N-terminal and C-terminal regions), and/or within the C-terminal region (e.g., within about the last 2, 3, 4, 5, 6, 7, 8, 9, 10, 20, 30, 40, 50, 60, 70, 80, 90, 100 or so amino acids). Preferably, the intracellular localization or targeting domain is fused to the N-terminus of the DGAT polypeptide, or near the N-terminus, for example, within about the 1-100 amino acids. In particular embodiments, the intracellular localization or targeting domain is fused to the second amino acid of a DGAT polypeptide, resulting in the removal of the first residue (the methionine residue of the AUG codon).

The intracellular localization domains described herein alter the intracellular localization of the DGAT protein(s) to which they are fused. Such alterations can thus be measured relative to the localization of the corresponding wild-type DGAT protein(s). In the most general aspects, a DGAT fusion protein is "targeted to" or "selectively localizes" to one or more defined intracellular region(s) of a photosynthetic microorganism, where at least about 30%, 40%, 50%, 60%, 70%, 80%, 90%, 95%, 98%, or nearly 100% of the DGAT fusion protein can be found associated with the defined intracellular region(s), relative to a cytoplasmic or a soluble fraction of the microorganism. In particular aspects, the intracellular region is one or more of the plasma membrane, a thylakoid, a vesicle, a lipid body, a glycogen granule, a polyhydroxybutyrate (PHB) body, a carboxysome, a cyanophycin granule, and/or an intracellular membrane, such as an intracellular membrane associated with a thylakoid, vesicle, lipid body, glycogen granule, PHB body, carboxysome, and/or cyanophycin granule. In certain embodiments, the enzymatic domain(s) of the DGAT fusion protein selectively localizes to the cytoplasmic side of the intracellular region(s) or associated membranes.

In more particular embodiments, a DGAT fusion protein is "targeted to" or "selectively localizes" to one or more membrane(s) of a photosynthetic microorganism, where at least about 30%, 40%, 50%, 60%, 70%, 80%, 90%, 95%, 98%, or nearly 100% of the fusion protein can be found associated with at least one membrane (e.g., a membrane fraction) upon expression in a given photosynthetic microorganism (e.g., Cyanobacteria), relative to other cellular spaces, such as a cytoplasmic or soluble fraction of the cell. Examples of membranes include the plasma membrane and any intracellular membranes, such as intracellular membranes associated with a thylakoid, vesicle, lipid body, glycogen granule, PHB body, carboxysome, and/or cyanophycin granule. In some embodiments, the enzymatic domain(s) of the DGAT fusion protein selectively localize to the cytoplasmic side of the membrane.

In certain embodiments, a DGAT fusion protein is "targeted to" or "selectively localizes" to the plasma membrane of a photosynthetic microorganism, where at least about 30%, 40%, 50%, 60%, 70%, 80%, 90%, 95%, 98%, or nearly 100% of the fusion protein can be found at the plasma membrane (or associated with the plasma membrane) upon expression in a given photosynthetic microorganism (e.g., Cyanobacteria), relative to other cellular spaces, such as the cytoplasm, vesicles, lipid bodies, thylakoids, glycogen granules, PHB bodies, carboxysomes, cyanophycin granules, other intracellular membranes (e.g., thylakoid membranes, lipid body membranes, vesicle membranes), or any combination thereof. Thylakoids consist of a thylakoid membrane surrounding a thylakoid lumen, and are the site of photosynthesis. In certain of these and related embodiments, the enzymatic domain(s) of the DGAT fusion protein selectively localize to the cytoplasmic side of the plasma membrane.

In particular aspects, the fusion to a heterologous intracellular localization domain limits the potential for DGAT-mediated photosystem disruption, generation of reactive oxygen species, and loss of cell viability, and thereby improves the cell growth phenotype of DGAT-expressing and lipid-producing photosynthetic microorganisms.

Intracellular Localization Domains.

Generally, the intracellular localization domain sequences of the DGAT fusion proteins described herein can be obtained from any one or more signal or other sequences that selectively localize a given protein to a defined intracellular region (for instance, relative to dispersal throughout the cytoplasm), such as the plasma membrane, a thylakoid, a vesicle, a lipid body, a glycogen granule, a PHB body, a carboxysome, a cyanophycin granule, or an intracellular membrane. Particular examples thus include membrane-, thylakoid-, vesicle-, lipid body-, glycogen granule-, polyhydroxybutyrate (PHB) body-, carboxysome-, and cyanophycin granule-targeting domains, including domains that target DGAT to the membranes associated with these intracellular regions. In specific instances, the intracellular localization domain selectively localizes the active domain(s) of DGAT to the cytoplasmic side of the intracellular region, so that DGAT can interact with lipid-producing substrates in the cytoplasm.

The intracellular localization domain can be any length that is sufficient to selectively localize the DGAT fusion protein(s) to an intracellular region of a membrane, such as the plasma membrane, and/or alter its relation to other cell membranes or substrates, and allow the enzymatic portions of the DGAT polypeptide to interact with lipid-producing substrates in the cytoplasm. For instance, in certain embodiments, the intracellular localization domain can be anywhere from about 10-1000 amino acids in length, including about 10, 15, 20, 25, 30, 35, 40, 45, 50, 55, 60, 65, 70, 75, 80, 85, 90, 95, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000 or more amino acids in length, including all integers and ranges in between (e.g., 20-100, 30-100, 40-100, 50-100, 20-200, 30-200, 40-200, 50-200 amino acids in length).

In particular embodiments, the intracellular localization domain is a membrane-targeting or plasma membrane (PM)-targeting domain. Such membrane-targeting sequences can be obtained or derived from any combination of N-terminal leader sequence(s), transmembrane domain sequence(s), and/or integral membrane sequence(s) of a bacterial membrane protein, such as a bacterial plasma membrane protein. In certain instances, such bacterial plasma membrane proteins (in their endogenous state) selectively localize to the plasma membrane, and are characterized by having at least one C-terminal region that is localized to the cytoplasmic side of a bacterial plasma membrane, and/or the periplasmic side of the outer membrane (for plasma membrane proteins derived from gram-negative bacteria).

A bacterial plasma membrane protein "selectively localizes" to the plasma membrane where at least about 30%, 40%, 50%, 60%, 70%, 80%, 90%, 95%, 98%, or nearly 100% of the protein can be found at the plasma membrane upon (preferably endogenous) expression in the bacteria from which it is derived (e.g., gram-positive bacteria, gram-negative bacteria, photosynthetic bacteria, Cyanobacteria), relative to other cellular spaces, such as the cytoplasm, the cell wall, other cellular 'organelles' or membranes, such as thylakoid membranes for certain photosynthetic bacteria, or any combination thereof.

In certain embodiments, the membrane-targeting or PM-targeting domain may comprise an amino acid sequence of an N-terminal leader sequence, an amino acid sequence of one or more transmembrane domains (e.g., 1, 2, 3, 4, 5, 6, 7, 8, 9, 10 or more transmembrane domains), an amino acid sequence of one or more integral membrane domains, or any combination thereof. When combined, the sequences of the N-terminal leader, the transmembrane domain(s), and/or the integral membrane domain(s) can be from the same or different bacterial plasma membrane protein(s).

Membrane-targeting or PM-targeting domain sequences can be obtained from (or derived from) the signal sequences, transmembrane domains, or integral membrane domains of any variety of bacterial membrane proteins. For instance, the bacterial membrane protein can be an integral membrane protein (IMP), such as a transmembrane protein (TP). In some instances, the membrane-targeting domain is obtained from a single-pass transmembrane protein, having only one domain that spans the lipid bilayer of the plasma membrane, or a multi-pass transmembrane protein, having about 2, 3, 4, 5, 6, 7, 8, 9, 10 or more domains that span the lipid bilayer of the plasma membrane. For the latter, the membrane-targeting domain can comprise any one or more of the multiple transmembrane domains. In certain aspects, the membrane-targeting domain or transmembrane domain (TMD) can comprise an alpha-helical transmembrane structure, or a beta-barrel transmembrane structure, the latter typically deriving from gram-negative outer membrane proteins.

In some embodiments, the membrane-targeting or PM-targeting domain does not span the entire lipid bilayer, but inserts into or attaches to the cytoplasmic side of the membrane, such as the plasma membrane. Examples include membrane-targeting domains that interact with the membrane by an amphipathic helix (e.g., parallel to the membrane plane), membrane-targeting domains that interact with the membrane by a hydrophobic loop, and membrane-targeting domains that interact with the membrane by electrostatic or ionic interactions, for example, through calcium ions.

In some embodiments, the membrane-targeting domain sequence is obtained from a membrane protein or plasma membrane protein of one or more gram-negative bacteria, gram-positive bacteria, or other bacteria, such as a Cyanobacteria. Exemplary bacteria are described elsewhere herein and known in the art.

In particular embodiments the membrane-targeting or PM-targeting domain sequence is obtained from a membrane protein or plasma membrane protein of a photosynthetic bacteria, such as a Cyanobacteria from the genera *Aphanocapsa, Aphanothece, Chamaesiphon, Chroococcus, Chroogloeocystis, Coelosphaerium, Crocosphaera, Cyanobacterium, Cyanobium, Cyanodictyon, Cyanosarcina, Cyanothece, Dactylococcopsis, Gloecapsa, Gloeothece, Merismopedia, Microcystis, Radiocystis, Rhabdoderma, Snowella, Synychococcus, Synechocystis, Thermosenechococcus,* and *Woronichinia; Nostacales* Cyanobacteria from the genera *Anabaena, Anabaenopsis, Aphanizomenon, Aulosira, Caolothrix, Coleodesmium, Cyanospira, Cylindrospermosis, Cylindrospermum, Fremyella, Gleotrichia, Microchaete, Nodularia, Nostoc, Rexia, Richelia, Scytonema, Sprirestis, Toypothrix, Oscillatoriales*; Cyanobacteria from the genera *Arthrospira, Geitlerinema, Haolomicronema, Halospirulina, Katagnymene, Leptolyngbya, Limnothrix, Lyngbya, Microcoleus, Oscillatoria, Phormidium, Planktothricoides, Planktothrix, Plectonema, Pseudoanabaena/Limnothrix, Schizothrix, Spirulina, Symploca, Trichodesmium, Tychonema; Pleurocapsales* cyanobacterium from the genera *Chroococcidiopsis, Dermocarpa, Dermocarpella, Myxosarcina, Pleurocapsa, Stanieria, Xenococcus, Prochlorophytes*; Cyanobacterium from the genera *Prochloron, Prochlorococcus, Prochlorothrix*; and *Stigonematales* cyanobacterium from the genera *Capsosira, Chlorogeoepsis, Fischerella, Hapalosiphon, Mastigocladopsis, Nostochopsis, Stigonema, Symphyonema, Symphonemopsis, Umezakia,* and *Westiellopsis*. In certain embodiments, the Cyanobacterium is from the genus *Synechococcus*, including, but not limited to *Synechococcus bigranulatus, Synechococcus elongatus, Synechococcus leopoliensis, Synechococcus lividus, Synechococcus nidulans,* and *Synechococcus rubescens*. In certain embodiments, the membrane-targeting domain sequence is derived from a plasma membrane protein from *S. elongatus* sp. strain PCC7942 or *Synechococcus* sp. PCC 7002 (originally known as *Agmenellum quadruplicatum*).

In some embodiments, the membrane protein is a plasma membrane receptor protein, such as a chemoreceptor or chemotaxis protein. Particular examples include integral membrane chemoreceptors, e.g., transmembrane chemoreceptors. Examples of chemoreceptors or chemotaxis proteins include methyl-accepting chemotaxis proteins and amino acid chemotaxis receptors, such as serine chemotaxis receptors (e.g., Tsr receptor from *Escherichia coli*) and aspartate chemotaxis receptors. The membrane-targeting domain can thus be obtained from the signal sequence and/or transmembrane domains of any one or more of such bacterial plasma membrane receptors.

In particular embodiments, the membrane-targeting domain is obtained from (or derived from) a methyl-accepting chemotaxis protein (MCP). MCPs can be classified by topology type (see Zhulin, *Adv Microb Physiol.* 45:157-198, 2001) and signaling domain class (see Alexander and Zhulin, *PNAS USA.* 104:2885-2890, 2007). Topology type I MCPs have large periplasmic ligand-binding domains and an elongated cytoplasmic region consisting of a HAMP domain (i.e., histidine kinases, adenylyl cyclases, methylbinding proteins, and phosphatases) followed by a signaling domain, which in turn is composed of "methylation," "flexible bundle," and "signaling" sub-domains (see Alexander and Zhulin, supra; and Hazelbauer et al., *Trends Biochem Sci.* 33:9-19, 2008). MCPs cluster together with other chemotaxis proteins in large arrays at the cell pole.

MCP arrays from variety of bacteria have been well-characterized, including, for example, *E. coli, C. crescentus, Thermotoga maritima, Magnetospirillum magneticum, Rhodobacter sphaeroides, Treponema primitia, Listeria monocytogenes, Helicobacter hepaticus, Campylobacter jejuni, Acetonema longum, Borrelia burgdorferi, Halothiobacillus neapolitanus,* and *Campylobacter jejuni* (see Briegel et al., *PNAS USA.* 106:17181-17186, 2009). The membrane-targeting domain can thus be derived from the signal sequence and/or transmembrane domains of an MCP from any one or more of these bacteria, or an MCP from any other bacteria described herein or known in the art.

In certain embodiments, the MCP is encoded by PCC7942-0858 or PCC7942-1015 from *S. elongatus*. The polypeptide and polynucleotide sequence of the *S. elongatus* PCC7942-0858 MCP are set forth in SEQ ID NOS:199 and 200, respectively, and the polypeptide and polynucleotide sequence of the *S. elongatus* PCC7942-1015 MCP are set forth in SEQ ID NOS:201 and 202, respectively.

In some embodiments, the membrane-targeting domain comprises or consists essentially of the N-terminal leader sequence, the first (N-terminal) transmembrane domain, and/or the second transmembrane domain of PCC7942-0858, singly or in combination together. In certain instances, the bacterial membrane-targeting domain comprises or consists essentially of about the N-terminal 43-53 amino acids of the MCP encoded by PCC7942-0858, for example, about residues 1-43, 4-44, 1-45, 1-46, 1-47, 1-48, 1-49, 1-50, 1-51, 1-52, 1-53, 1-54, 1-55, 1-56, 1-57, 1-58, 1-59, 1-60 of SEQ ID NO:199. In specific instances, the bacterial membrane-targeting domain comprises or consists essentially of the N-terminal signal sequence and the two N-terminally proximal TMDs of the MCP encoded by PCC7942-0858, for example, about residues 1-43 of SEQ ID NO:199.

DGAT Polypeptides.

As used herein, a "diacylglycerol acyltransferase" (DGAT) polypeptide includes any protein, polypeptide or peptide, obtainable from any cell source, which demonstrates the ability to catalyze the production of triacylglycerol from 1,2-diacylglycerol and fatty acyl substrates under enzyme reactive conditions, in addition to any naturally-occurring (e.g., allelic variants, orthologs) or non-naturally occurring variants of a diacylglycerol acyltransferase sequence having such ability. DGAT polypeptides of the present disclosure also include bi-functional proteins, such as those bi-functional proteins that exhibit a DGAT activity as well as a CoA:fatty alcohol acyltransferase activity, e.g., a wax ester synthesis (WES) activity, as often found in many TAG producing bacteria.

Diacylglycerol acyltransferases (DGATs) are members of the O-acyltransferase superfamily, which esterify either sterols or diacyglycerols in an oleoyl-CoA-dependent manner. DGAT in particular esterifies diacylglycerols, which reaction represents the final enzymatic step in the production of triacylglycerols in plants, fungi and mammals. Specifically, DGAT is responsible for transferring an acyl group from acyl-coenzyme-A to the sn-3 position of 1,2-diacylglycerol (DAG) to form triacylglycerol (TAG). DGAT is an integral membrane protein that has been generally described in Harwood (*Biochem. Biophysics. Acta,* 1301:7-56, 1996), Daum et al. (*Yeast* 16:1471-1510, 1998), and Coleman et al. (*Annu. Rev. Nutr.* 20:77-103, 2000) (each of which are herein incorporated by reference).

In plants and fungi, DGAT is associated with the membrane and lipid body fractions. In catalyzing TAGs, DGAT contributes mainly to the storage of carbon used as energy reserves. In animals, however, the role of DGAT is more complex. DGAT not only plays a role in lipoprotein assembly and the regulation of plasma triacylglycerol concentration (Bell, R. M., et al.), but participates as well in the regulation of diacylglycerol levels (see Brindley, *Biochemistry of Lipids,* Lipoproteins and Membranes, eds. Vance, D. E. & Vance, J. E. (Elsevier, Amsterdam), 171-203; and Nishizuka, *Science* 258:607-614, 1992, each of which are incorporated by reference).

In eukaryotes, at least three independent DGAT gene families (DGAT1, DGAT2, and PDAT) have been described that encode proteins with the capacity to form TAG. Yeast contain all three of DGAT1, DGAT2, and PDAT, but the expression levels of these gene families varies during different phases of the life cycle (Dahlqvst, A., et al. *Proc. Natl. Acad. Sci.* USA 97:6487-6492, 2000, incorporated by reference).

In prokaryotes, WS/DGAT from *Acinetobacter calcoaceticus* ADP1 represents the first identified member of a widespread class of bacterial wax ester and TAG biosynthesis enzymes. This enzyme comprises a putative membrane-spanning region but shows no sequence homology to the DGAT1 and DGAT2 families from eukaryotes. Under in vitro conditions, WS/DGAT shows a broad capability of utilizing a large variety of fatty alcohols, and even thiols as acceptors of the acyl moieties of various acyl-CoA thioesters. WS/DGAT acyltransferase enzymes exhibit extraordinarily broad substrate specificity. Genes for homologous acyltransferases have been found in almost all bacteria capable of accumulating neutral lipids, including, for example, *Acinetobacter baylii, A. baumanii,* and *M. avium,* and *M. tuberculosis* CDC1551, in which about 15 functional homologues are present (see, e.g., Daniel et al., *J. Bacteriol.* 186:5017-5030, 2004; and Kalscheuer et al., *J. Biol. Chem.* 287:8075-8082, 2003).

DGAT proteins may utilize a variety of acyl substrates in a host cell, including fatty acyl-CoA and fatty acyl-ACP molecules. In addition, the acyl substrates acted upon by DGAT enzymes may have varying carbon chain lengths and degrees of saturation, although DGAT may demonstrate preferential activity towards certain molecules.

Like other members of the eukaryotic O-acyltransferase superfamily, eukaryotic DGAT polypeptides typically contain a FYxDWWN (SEQ ID NO:15) heptapeptide retention motif, as well as a histidine (or tyrosine)-serine-phenylalanine (H/YSF) tripeptide motif, as described in Zhongmin et al. (*Journal of Lipid Research,* 42:1282-1291, 2001) (herein incorporated by reference). The highly conserved FYxD-WWN (SEQ ID NO:15) is believed to be involved in fatty Acyl-CoA binding. In certain instances, the DGAT polypeptide portion of the fusion proteins described herein may thus comprise one or more these motifs.

DGAT polypeptides utilized according to the fusion proteins described herein may be isolated from any organism, including eukaryotic and prokaryotic organisms. Eukaryotic organisms having a DGAT gene are well-known in the art, and include various animals (e.g., mammals, fruit flies, nematodes), plants, parasites, and fungi (e.g., yeast such as S. cerevisiae and Schizosaccharomyces pombe). Examples of prokaryotic organisms include certain actinomycetes, a group of Gram-positive bacteria with high G+C ratio, such as those from the representative genera Actinomyces, Arthrobacter, Corynebacterium, Frankia, Micrococcus, Mocrimonospora, Mycobacterium, Nocardia, Propionibacterium, Rhodococcus and Streptomyces. Particular examples of actinomycetes that have one or more genes encoding a DGAT activity include, for example, Mycobacterium tuberculosis, M. avium, M. smegmatis, Micromonospora echinospora, Rhodococcus opacus, R. ruber, and Streptomyces lividans.

Additional examples of prokaryotic organisms that encode one or more enzymes having a DGAT activity include members of the genera Acinetobacter, such as A. calcoaceticus, A. baumanii, A. baylii, and members of the genera Alcanivorax. In certain embodiments, a DGAT polypeptide is from Acinetobacter baylii sp. ADP1, a gram-negative triglyceride forming prokaryote, which contains a well-characterized DGAT (AtfA).

In particular embodiments, the DGAT polypeptide is an Acinetobacter DGAT (ADGAT), a Streptomyces DGAT, or an Alcanivorax DGAT. In certain embodiments, the DGAT polypeptide comprises or consists of a polypeptide sequence set forth in any one of SEQ ID NOs:58, 59, 60, or 61, or a fragment or variant thereof. SEQ ID NO:58 is the sequence of DGATn; SEQ ID NO:59 is the sequence of Streptomyces coelicolor DGAT (ScoDGAT or SDGAT); SEQ ID NO:60 is the sequence of Alcanivorax borkumensis DGAT (AboD-GAT); and SEQ ID NO:61 is the sequence of DGATd.

In certain embodiments, the modified photosynthetic microorganisms of the present disclosure may express two or more intracellular localization domain-DGAT fusion proteins. The DGAT polypeptides may by the same or different. In particular embodiments, the following intracellular localization domain-DGAT fusions are co-expressed in modified photosynthetic microorganisms, e.g., Cyanobacteria, using one of the following double DGAT strains: ADGATd:: ScoDGAT; ADGATd(NS1)::ADGATd(NS2); ADGATn (NS1)::ADGATn(NS2); ADGATn(NS1)::SDGAT(NS2); SDGAT(NS1)::ADGATn(NS2); SDGAT(NS1)::SDGAT (NS2). For the NS1 vector, pAM2291, EcoRI follows ATG and is part of the open reading frame (ORF). For the NS2 vector, pAM1579, EcoRI follows ATG and is part of the ORF. A DGAT having EcoRI nucleotides following ATG may be cloned in either pAM2291 or pAM1579; such a DGAT is referred to as ADGATd. Other embodiments utilize the vector, pAM2314FTrc3, which is an NS1 vector with Nde/BglII sites, or the vector, pAM1579FTrc3, which is the NS2 vector with Nde/BglII sites. A DGAT without EcoRI nucleotides may be cloned into either of these last two vectors. Such a DGAT is referred to as ADGATn. Modified photosynthetic microorganisms expressing different DGATs express TAGs having different fatty acid compositions. Accordingly, certain embodiments contemplate expressing two or more different intracellular localization domain-DGAT fusions, in order to produce TAGs having varied fatty acid compositions.

Peptide Linkers.

In certain embodiments, a peptide linker sequence may be employed to separate the DGAT polypeptide(s) and the heterologous intracellular localization domain(s) by a distance sufficient to ensure that each polypeptide folds into its desired secondary and tertiary structures. Such a peptide linker sequence can be incorporated into the fusion protein using standard techniques well known in the art.

Certain peptide linker sequences may be chosen based on the following exemplary factors: (1) their ability to adopt a flexible extended conformation; (2) their inability to adopt a secondary structure that could interact with functional epitopes on the first and second polypeptides; (3) their physiological stability; and (4) the lack of hydrophobic or charged residues that might react with the polypeptide functional epitopes, or other features. See, e.g., George and Heringa, J Protein Eng. 15:871-879, 2002.

The linker sequence can be essentially any length, but is generally from about 1 to about 300 amino acids in length. Particular linkers can have an overall amino acid length of about 1-300 amino acids, 1-250, 1-200 amino acids, 1-150 amino acids, 1-100 amino acids, 1-90 amino acids, 1-80 amino acids, 1-70 amino acids, 1-60 amino acids, 1-50 amino acids, 1-40 amino acids, 1-30 amino acids, 1-20 amino acids, 1-10 amino acids, 1-5 amino acids, 1-4 amino acids, 1-3 amino acids, or about 1, 2, 3, 4, 5, 6, 7, 8, 9, 10, 11, 12, 13, 14, 15, 16, 17, 18, 19, 20, 21, 22, 23, 24, 25, 26, 27, 28, 29, 30, 31, 32, 33, 34, 35, 36, 37, 38, 39, 40, 41, 42, 43, 44, 45, 46, 47, 48, 49, 50, 60, 70, 80, 90, 100, 110, 120, 130, 140, 150, 160, 170, 180, 190, 200, 210, 220, 230, 240, 250, 260, 270, 280, 290, 300 or more amino acids in length.

Certain amino acid sequences which may be usefully employed as linkers include those disclosed in Maratea et al., Gene 40:39-46, 1985; Murphy et al., PNAS USA. 83:8258-8262, 1986; U.S. Pat. No. 4,935,233 and U.S. Pat. No. 4,751,180. Particular peptide linker sequences contain Gly, Ser, and/or Asn residues. Other near neutral amino acids, such as Thr and Ala may also be employed in the peptide linker sequence, if desired.

Certain exemplary linkers include Gly, Ser and/or Asn-containing linkers, as follows: $[G]_x$, $[S]_x$, $[N]_x$, $[GS]_x$, $[GGS]_x$, $[GSS]_x$, $[GSGS]_x$ (SEQ ID NO:203), $[GGSG]_x$ (SEQ ID NO:204), $[GGGS]_x$ (SEQ ID NO:205), $[GGGGS]_x$ (SEQ ID NO:206), $[GN]_x$, $[GGN]_x$, $[GNN]_x$, $[GNGN]_x$ (SEQ ID NO:207), $[GGNG]_x$ (SEQ ID NO:208), $[GGGN]_x$ (SEQ ID NO:209), $[GGGGN]_x$ (SEQ ID NO:210) linkers, where x is 1, 2, 3, 4, 5, 6, 7, 8, 9, 10, 11, 12, 13, 14, 15, 16, 17, 18, 19, 20, 25, 30, 40, 50 or more. Other combinations of these and related amino acids will be apparent to persons skilled in the art.

In certain embodiments, however, any one or more of the peptide linkers are optional. For instance, linker sequences may not required when the bacterial membrane protein (from which the membrane- or PM-targeting domain is derived) and the DGAT polypeptides have non-essential regions (e.g., N-terminal and/or C-terminal amino acids, or for the plasma membrane proteins, regions just downstream of the signal sequences and/or transmembrane domains) that can be used to separate the functional domains and prevent steric interference.

(ii) Lipid Biosynthesis Proteins

In various embodiments, modified photosynthetic microorganisms of the present disclosure further comprise one or more exogenous (e.g., introduced) or overexpressed nucleic acids that encode a lipid biosynthesis protein, e.g., a polypeptide having an activity associated with triglyceride biosynthesis or fatty acid biosynthesis, including but not limited to any of those described herein. In particular instances, a modified photosynthetic microorganism may comprise reduced expression and/or activity of one or more selected lipid biosynthesis proteins. Certain of these proteins are described in greater detail below.

In particular embodiments, the exogenous nucleic acid does not comprise a nucleic acid sequence that is native to the microorganism's genome. In some embodiments, the exogenous nucleic acid comprises a nucleic acid sequence that is native to the microorganism's genome, but it has been introduced into the microorganism, e.g., in a vector or by molecular biology techniques, for example, to increase expression of the nucleic acid and/or its encoded polypeptide in the microorganism. In certain embodiments, the expression of a native or endogenous nucleic acid and its corresponding protein can be increased by introducing a heterologous promoter upstream of the native gene. As noted above, lipid biosynthesis proteins can be involved in triglyceride biosynthesis, fatty acid synthesis, wax ester synthesis, or any combination thereof.

Triglyceride Biosynthesis.

Triglycerides, or triacylglycerols (TAGs), consist primarily of glycerol esterified with three fatty acids, and yield more energy upon oxidation than either carbohydrates or proteins. Triglycerides provide an important mechanism of energy storage for most eukaryotic organisms. In mammals, TAGs are synthesized and stored in several cell types, including adipocytes and hepatocytes (Bell et al. *Annu. Rev. Biochem.* 49:459-487, 1980) (incorporated by reference). In plants, TAG production is mainly important for the generation of seed oils.

In contrast to eukaryotes, the observation of triglyceride production in prokaryotes has been limited to certain actinomycetes, such as members of the genera *Mycobacterium, Nocardia, Rhodococcus* and *Streptomyces*, in addition to certain members of the genus *Acinetobacter*. In certain Actinomycetes species, triglycerides may accumulate to nearly 80% of the dry cell weight, but accumulate to only about 15% of the dry cell weight in *Acinetobacter*. In general, triglycerides are stored in spherical lipid bodies, with quantities and diameters depending on the respective species, growth stage, and cultivation conditions. For example, cells of *Rhodococcus opacus* and *Streptomyces lividans* contain only few TAGs when cultivated in complex media with a high content of carbon and nitrogen; however, the lipid content and the number of TAG bodies increase drastically when the cells are cultivated in mineral salt medium with a low nitrogen-to-carbon ratio, yielding a maximum in the late stationary growth phase. At this stage, cells can be almost completely filled with lipid bodies exhibiting diameters ranging from 50 to 400 nm. One example is *R. opacus* PD630, in which lipids can reach more than 70% of the total cellular dry weight.

In bacteria, TAG formation typically starts with the docking of a diacylglycerol acyltransferase enzyme to the plasma membrane, followed by formation of small lipid droplets (SLDs). These SLDs are only some nanometers in diameter and remain associated with the membrane-docked enzyme. In this phase of lipid accumulation, SLDs typically form an emulsive, oleogenous layer at the plasma membrane. During prolonged lipid synthesis, SLDs leave the membrane-associated acyltransferase and conglomerate to membrane-bound lipid prebodies. These lipid prebodies reach distinct sizes, e.g., about 200 nm in *A. calcoaceticus* and about 300 nm in *R. opacus*, before they lose contact with the membrane and are released into the cytoplasm. Free and membrane-bound lipid prebodies correspond to the lipid domains occurring in the cytoplasm and at the cell wall, as observed in *M. smegmatis* during fluorescence microscopy and also confirmed in *R. opacus* PD630 and *A. calcoaceticus* ADP1 (see, e.g., Christensen et al., *Mol. Microbiol.* 31:1561-1572, 1999; and Waltermann et al., *Mol. Microbiol.* 55:750-763, 2005). Inside the lipid prebodies, SLDs coalesce with each other to form the homogenous lipid core found in mature lipid bodies, which often appear opaque in electron microscopy.

The compositions and structures of bacterial TAGs vary considerably depending on the microorganism and on the carbon source. In addition, unusual acyl moieties, such as phenyldecanoic acid and 4,8,12 trimethyl tridecanoic acid, may also contribute to the structural diversity of bacterial TAGs (see, e.g., Alvarez et al., *Appl Microbiol Biotechnol.* 60:367-76, 2002).

As with eukaryotes, the main function of TAGs in prokaryotes is to serve as a storage compound for energy and carbon. TAGs, however, may provide other functions in prokaryotes. For example, lipid bodies may act as a deposit for toxic or useless fatty acids formed during growth on recalcitrant carbon sources, which must be excluded from the plasma membrane and phospholipid (PL) biosynthesis. Furthermore, many TAG-accumulating bacteria are ubiquitous in soil, and in this habitat, water deficiency causing dehydration is a frequent environmental stress. Storage of evaporation-resistant lipids might be a strategy to maintain a basic water supply, since oxidation of the hydrocarbon chains of the lipids under conditions of dehydration would generate considerable amounts of water. Cyanobacteria such as *Synechococcus*, however, do not produce triglycerides, because these organisms lack the enzymes necessary for triglyceride biosynthesis.

Triglycerides are synthesized from fatty acids and glycerol. As one mechanism of triglyceride (TAG) synthesis, sequential acylation of glycerol-3-phosphate via the "Kennedy Pathway" leads to the formation of phosphatidate. Phosphatidate is then dephosphorylated by the enzyme phosphatidate phosphatase to yield 1,2 diacylglycerol (DAG). Using DAG as a substrate, at least three different classes of enzymes are capable of mediating TAG formation. As one example, an enzyme having diacylglycerol acyltransferase (DGAT) activity catalyzes the acylation of DAG using acyl-CoA as a substrate. Essentially, DGAT enzymes combine acyl-CoA with 1,2 diacylglycerol molecule to form a TAG. As an alternative, Acyl-CoA-independent TAG synthesis may be mediated by a phospholipid:DAG acyltransferase found in yeast and plants, which uses phospholipids as acyl donors for DAG esterification. Third, TAG synthesis in animals and plants may be mediated by a DAG-DAG-transacylase, which uses DAG as both an acyl donor and acceptor, yielding TAG and monoacylglycerol.

Modified photosynthetic microorganisms, e.g., Cyanobacteria, of the present disclosure may comprise one or more exogenous polynucleotides encoding polypeptides comprising one or more of the polypeptides and enzymes described herein.

Since wild type Cyanobacteria do not typically encode the enzymes necessary for triglyceride synthesis, such as the enzymes having diacylglycerol acyltransferase activity, embodiments of the present disclosure include genetically modified Cyanobacteria that comprise polynucleotides encoding one or more DGAT fusion proteins, optionally in combination with one or more enzymes having a fatty acyl-CoA synthetase activity. In particular embodiments, the one or more exogenous polynucleotides encode a DGAT fusion protein described herein and a fatty acyl-CoA synthetase, or a functional variant or fragment thereof.

Moreover, since triglycerides are typically formed from fatty acids, the level of fatty acid biosynthesis in a cell may limit the production of triglycerides. Increasing the level of fatty acid biosynthesis may, therefore, allow increased production of triglycerides. As discussed below, acetyl-CoA carboxylase catalyzes the commitment step to fatty acid biosynthesis. Thus, certain embodiments of the present disclosure include Cyanobacterium, and methods of use thereof, comprising polynucleotides that encode one or more enzymes having acetyl-CoA carboxylase activity to increase fatty acid biosynthesis and lipid production, in addition to one or more DGAT fusion proteins and optionally one or more enzymes having fatty acyl-CoA synthetase activity, to catalyze triglyceride production. These and related embodiments are detailed below.

Fatty Acid Biosynthesis.

Fatty acids are a group of negatively charged, linear hydrocarbon chains of various length and various degrees of oxidation states. The negative charge is located at a carboxyl end group and is typically deprotonated at physiological pH values (pK~2-3). The length of the fatty acid 'tail' determines its water solubility (or rather insolubility) and amphipathic characteristics. Fatty acids are components of phospholipids and sphingolipids, which form part of biological membranes, as well as triglycerides, which are primarily used as energy storage molecules inside cells.

Fatty acids are formed from acetyl-CoA and malonyl-CoA precursors. Malonyl-CoA is a carboxylated form of acetyl-CoA, and contains a 3-carbon dicarboxylic acid, malonate, bound to Coenzyme A. Acetyl-CoA carboxylase catalyzes the 2-step reaction by which acetyl-CoA is carboxylated to form malonyl-CoA. In particular, malonate is formed from acetyl-CoA by the addition of $CO_2$ using the biotin cofactor of the enzyme acetyl-CoA carboxylase.

Fatty acid synthase (FAS) carries out the chain elongation steps of fatty acid biosynthesis. FAS is a large multienzyme complex. In mammals, FAS contains two subunits, each containing multiple enzyme activities. In bacteria and plants, individual proteins, which associate into a large complex, catalyze the individual steps of the synthesis scheme. For example, in bacteria and plants, the acyl carrier protein is a smaller, independent protein.

Fatty acid synthesis starts with acetyl-CoA, and the chain grows from the "tail end" so that carbon 1 and the alpha-carbon of the complete fatty acid are added last. The first reaction is the transfer of an acetyl group to a pantothenate group of acyl carrier protein (ACP), a region of the large mammalian fatty acid synthase (FAS) protein. In this reaction, acetyl CoA is added to a cysteine —SH group of the condensing enzyme (CE) domain: acetyl CoA+CE-cys-SH→acetyl-cys-CE+CoASH. Mechanistically, this is a two step process, in which the group is first transferred to the ACP (acyl carrier peptide), and then to the cysteine —SH group of the condensing enzyme domain.

In the second reaction, malonyl CoA is added to the ACP sulfhydryl group: malonyl CoA+ACP-SH→malonyl ACP+CoASH. This —SH group is part of a phosphopantethenic acid prosthetic group of the ACP.

In the third reaction, the acetyl group is transferred to the malonyl group with the release of carbon dioxide: malonyl ACP+acetyl-cys-CE→beta-ketobutyryl-ACP+$CO_2$.

In the fourth reaction, the keto group is reduced to a hydroxyl group by the beta-ketoacyl reductase activity: beta-ketobutyryl-ACP+NADPH+$H^+$→beta-hydroxybutyryl-ACP+$NAD^+$.

In the fifth reaction, the beta-hydroxybutyryl-ACP is dehydrated to form a trans-monounsaturated fatty acyl group by the beta-hydroxyacyl dehydratase activity: beta-hydroxybutyryl-ACP→2-butenoyl-ACP+$H_2O$.

In the sixth reaction, the double bond is reduced by NADPH, yielding a saturated fatty acyl group two carbons longer than the initial one (an acetyl group was converted to a butyryl group in this case): 2-butenoyl-ACP+NADPH+$H^+$→butyryl-ACP+$NADP^+$. The butyryl group is then transferred from the ACP sulfhydryl group to the CE sulfhydryl: butyryl-ACP+CE-cys-SH→ACP-SH+butyryl-cys-CE. This step is catalyzed by the same transferase activity utilized previously for the original acetyl group. The butyryl group is now ready to condense with a new malonyl group (third reaction above) to repeat the process. When the fatty acyl group becomes 16 carbons long, a thioesterase activity hydrolyses it, forming free palmitate: palmitoyl-ACP+$H_2O$→palmitate+ACP-SH. Fatty acid molecules can undergo further modification, such as elongation and/or desaturation.

Modified photosynthetic microorganisms, e.g., Cyanobacteria, may comprise one or more exogenous polynucleotides encoding any of the above polypeptides or enzymes involved in fatty acid synthesis. In particular embodiments, the enzyme is an acetyl-CoA carboxylase or a variant or functional fragment thereof.

Wax Ester Synthesis.

Wax esters are esters of a fatty acid and a long-chain alcohol. These neutral lipids are composed of aliphatic alcohols and acids, with both moieties usually long-chain (e.g., $C_{16}$ and $C_{18}$) or very-long-chain ($C_{20}$ and longer) carbon structures, though medium-chain-containing wax esters are included (e.g., $C_{10}$, $C_{12}$ and $C_{14}$). Wax esters have diverse biological functions in bacteria, insects, mammals, and terrestrial plants and are also important substrates for a variety of industrial applications. Various types of wax ester are widely used in the manufacture of fine chemicals such as cosmetics, candles, printing inks, lubricants, coating stuffs, and others.

In certain organisms, such as *Acinetobacter*, the pathway for wax ester synthesis of *Acinetobacter* spp. has been assumed to start from acyl coenzyme A (acyl-CoA), which is then reduced to the corresponding alcohol via acyl-CoA reductase and aldehyde reductase. In other organisms, for example, wax ester biosynthesis involves elongation of saturated $C_{16}$ and $C_{18}$ fatty acyl-CoAs to very-long-chain fatty acid wax precursors between 24 and 34 carbons in length, and their subsequent modification by either the alkane-forming (decarbonylation) or the alcohol-forming (acyl reduction) pathway (see Li et al., *Plant Physiology* 148:97-107, 2008).

In certain aspects, wax ester synthesis can occur via the acyl-ACP=>acyl aldehyde pathway. In this pathway, acyl-ACP reductase overexpression increases conversion of acyl-ACP into acyl aldehydes, alcohol dehydrogenase overexpression then increases conversion of acyl aldehydes into fatty alcohols, and DGAT overexpression cooperatively increases conversion of the fatty alcohols into their corresponding wax esters. Modified photosynthetic microorganisms, e.g., Cyanobacteria, may therefore comprise one or more exogenous polynucleotides encoding any of the above polypeptides or enzymes involved in wax ester synthesis.

Acyl Carrier Proteins.

Embodiments of the present disclosure optionally include one or more exogenous (e.g., recombinantly introduced) or overexpressed ACP proteins. These proteins play crucial roles in fatty acid synthesis. Fatty acid synthesis in bacteria, including Cyanobacteria, is carried out by highly conserved enzymes of the type II fatty acid synthase system (FAS II; consisting of about 19 genes) in a sequential, regulated manner. Acyl carrier protein (ACP) plays a central role in this process by carrying all the intermediates as thioesters attached to the terminus of its 4'-phosphopantetheine prosthetic group (ACP-thioesters). Apo-ACP, the product of acp gene, is typically activated by a phosphopantetheinyl transferase (PPT) such as the acyl carrier protein synthase (AcpS) type found in *E. coli* or the Sfp (surfactin type) PPT as characterized in *Bacillus subtilis*. Cyanobacteria possess an Sfp-like PPT, which is understood to act in both primary and secondary metabolism. Embodiments of the present disclosure therefore include overexpression of PPTs such as AcpS and/or Sfp-type PPTs in combination with overexpression of cognate ACP encoding genes, such as ACP.

The ACP-thioesters are substrates for all of the enzymes of the FAS II system. The end product of fatty acid synthesis is a long acyl chain typically consisting of about 14-18 carbons attached to ACP by a thioester bond.

At least three enzymes of the FAS II system in other bacteria can be subject to feedback inhibition by acyl-ACPs: 1) the ACCase complex—a heterotetramer of the AccABCD genes that catalyzes the production of malonyl-coA, the first step in the pathway; 2) the product of the FabH gene (β-ketoacyl-ACP synthase III), which catalyzes the condensation of acetyl-CoA with malonyl-ACP; and 3) the product of the FabI gene (enoyl-ACP reductase), which catalyzes the final elongation step in each round of elongation. Certain proteins such as acyl-ACP reductase are capable of increasing fatty acid production in photosynthetic bacteria such as Cyanobacteria, and it is believed that overexpression of ACP in combination with this protein and possibly other biosynthesis proteins will further increases fatty acid production in such strains.

An ACP can be derived from a variety of eukaryotic organisms, microorganisms (e.g., bacteria, fungi), or plants. In certain embodiments, an ACP polynucleotide sequence and its corresponding polypeptide sequence are derived from Cyanobacteria such as *Synechococcus*. In certain embodiments, ACPs can be derived from plants such as spinach. SEQ ID NOS:5-12 provide the nucleotide and polypeptide sequences of exemplary bacterial ACPs from *Synechococcus* and *Acinetobacter*, and SEQ ID NOS:13-14 provide the same for an exemplary plant ACP from *Spinacia oleracea* (spinach). SEQ ID NOS:5 and 6 derive from *Synechococcus elongatus* PCC7942, and SEQ ID NOS:7-12 derive from *Acinetobacter* sp. ADP1.

Examples of prokaryotic organisms having an ACP include certain actinomycetes, a group of Gram-positive bacteria with high G+C ratio, such as those from the representative genera *Actinomyces, Arthrobacter, Corynebacterium, Frankia, Micrococcus, Mocrimonospora, Mycobacterium, Nocardia, Propionibacterium, Rhodococcus* and *Streptomyces*. Particular examples of actinomycetes that have one or more genes encoding an ACP activity include, for example, *Mycobacterium tuberculosis, M. avium, M. smegmatis, Micromonospora echinospora, Rhodococcus opacus, R. ruber*, and *Streptomyces lividans*. Additional examples of prokaryotic organisms that encode one or more enzymes having an ACP activity include members of the genera *Acinetobacter*, such as *A. calcoaceticus, A. baumanii, A. baylii*, and members of the genera *Alcanivorax*. In certain embodiments, an ACP gene or enzyme is isolated from *Acinetobacter baylii* sp. ADP1, a gram-negative triglyceride forming prokaryote.

Acyl ACP Synthases (Aas).

Acyl-ACP synthetases (Aas) catalyze the ATP-dependent acylation of the thiol of acyl carrier protein (ACP) with fatty acids, including those fatty acids having chain lengths from about C4 to C18. In Cyanobacteria, among other functions, Aas enzymes not only directly incorporate exogenous fatty acids from the culture medium into other lipids, but also play a role in the recycling of acyl chains from lipid membranes. Deletion of Aas in cyanobacteria can lead to secretion of free fatty acids into the culture medium. See, e.g., Kaczmarzyk and Fulda, *Plant Physiology* 152:1598-1610, 2010.

Certain embodiments may overexpress one or more Aas polypeptides described herein and known in the art. According to one non-limiting theory, overexpression of Aas in combination with overexpression of ACP leads to increased TAG production in DGAT-expressing strains, for example, by boosting acyl-ACP levels. Overexpression of Aas in optional combination with overexpression of ACP may likewise increase wax ester formation, for example, when combined with overexpression of one or more alcohol dehydrogenase(s) and wax ester synthase(s), such as a bi-functional DGAT. Certain embodiments therefore include modified photosynthetic microorganisms comprising overexpressed Aas polypeptide(s), optionally in combination with overexpressed ACP polypeptide(s), especially when combined with overexpression of alcohol dehydrogenase, acyl-ACP reductase (e.g., orf1594), and wax ester synthase (e.g., aDGAT).

Examples of bacterial Aas enzymes include those derived from *E. coli, Acinetobacter*, and *Vibrio* sp. such as *V. harveyi* (see, e.g., Shanklin, *Protein Expression and Purification*. 18:355-360, 2000; Jiang et al., *Biochemistry*. 45:10008-10019, 2006). SEQ ID NOS:43 and 44, respectively, provide the nucleotide and polypeptide sequences of an exemplary Aas from *Synechococcus elongatus* PCC 7942 (0918).

In certain embodiments, the Aas is derived from the same organism as the overexpressed ACP, DGAT, and/or the TES, if any one of these polypeptides is employed in combination with an Aas. Accordingly, certain embodiments include Aas sequences from any of the organisms described herein for deriving a DGAT or TES, including, for example, various animals (e.g., mammals, fruit flies, nematodes), plants, parasites, and fungi (e.g., yeast such as *S. cerevisiae* and *Schizosaccharomyces pombe*). Examples of prokaryotic organisms include certain actinomycetes, a group of Gram-positive bacteria with high G+C ratio, such as those from the representative genera *Actinomyces, Arthrobacter, Corynebacterium, Frankia, Micrococcus, Mocrimonospora, Mycobacterium, Nocardia, Propionibacterium, Rhodococcus* and *Streptomyces*. Particular examples of actinomycetes that have one or more genes encoding an Aas activity include, for example, *Mycobacterium tuberculosis, M. avium, M. smegmatis, Micromonospora echinospora, Rhodococcus opacus, R. ruber*, and *Streptomyces lividans*. Additional examples of prokaryotic organisms that encode one or more enzymes having an Aas activity include members of the genera *Acinetobacter*, such as *A. calcoaceticus, A. baumanii, A. baylii*, and members of the genera *Alcanivorax*. In certain embodiments, an Aas gene or enzyme is isolated from *Acinetobacter baylii* sp. ADP1, a gram-negative triglyceride forming prokaryote.

According to one non-limiting theory, an endogenous aldehyde dehydrogenase may be acting on the excess acylaldehydes generated by overexpressed orf1594 and converting them to free fatty acids. The normal role of such a dehydrogenase might involve removing or otherwise dealing with damaged lipids. In this scenario, it is then likely that the Aas gene product recycles these free fatty acids by ligating them to ACP. Accordingly, reducing or eliminating expression of the Aas gene product might ultimately increase production of fatty acids, by reducing or preventing their transfer to ACP. Hence, certain aspects include mutations (e.g., genomic) such as point mutations or insertions that reduce or eliminate the enzymatic activity of one or more endogenous acyl-ACP synthetases (or synthases). Also included are full or partial deletions of an endogenous gene encoding an Aas protein.

Acyl-ACP Reductases.

Acyl-ACP reductases (or acyl-ACP dehydrogenases) are members of the reductase or short-chain dehydrogenase family, and are key enzymes of the type II fatty acid synthesis (FAS) system. Among other potential catalytic activities, an "acyl-ACP reductase" or "acyl-ACP dehydrogenase" as used herein is capable of catalyzing the conversion (reduction) of acyl-ACP to an acyl aldehyde (see Schirmer et al., supra) and the concomitant oxidation of NAD(P)H to NADP+. In some embodiments, the acyl-ACP reductase preferentially interacts with acyl-ACP, and does not interact significantly with acyl-CoA, i.e., it does not significantly catalyze the conversion of acyl-CoA to acyl aldehyde.

Acyl-ACP reductases can be derived from a variety of plants and bacteria, included photosynthetic microorganisms such as Cyanobacteria. One exemplary acyl-ACP reductase is encoded by orf1594 of *Synechococcus elongatus* PCC7942 (see SEQ ID NOs:1 and 2 for the polynucleotide and polypeptide sequences, respectively). Another exemplary acyl-ACP reductase is encoded by orfsll0209 of *Synechocystis* sp. PCC6803 (SEQ ID NOs:3 and 4 for the polynucleotide and polypeptide sequences, respectively).

Alcohol Dehydrogenases.

Embodiments of the present disclosure optionally include one or more alcohol dehydrogenase polypeptides. Examples of alcohol dehydrogenases include those capable of using acyl or fatty aldehydes (e.g., one or more of nonyl-aldehyde, $C_{12}$, $C_{14}$, $C_{16}$, $C_{18}$, $C_{20}$ fatty aldehyde) as a substrate, and converting them into fatty alcohols. Specific examples include long-chain alcohol dehydrogenases, capable of using long-chain aldehydes (e.g., $C_{16}$, $C_{18}$, $C_{20}$) as substrates. In certain embodiments, the alcohol dehydrogenase is naturally-occurring or endogenous to the modified microorganism, and is sufficient to convert increased acyl aldehydes (produced by acyl-ACP reductase) into fatty alcohols, and thereby contribute to increased wax ester production and overall satisfactory growth characteristics. In certain embodiments, the alcohol dehydrogenase is derived from a microorganism that differs from the one being modified.

In these and related embodiments, expression or overexpression of an alcohol dehydrogenase may increase shunting of acyl aldehydes towards production of fatty alcohols, and away from production of other products such as alkanes, fatty acids, or triglycerides. When combined with one or more wax ester synthases, such as DGAT or other enzyme having wax ester synthase activity (e.g., the ability to convert fatty alcohols into wax esters), alcohol dehydrogenases may contribute to production of wax esters. They may also reduce accumulation of potentially toxic acyl aldehydes, and thereby improve growth characteristics of a modified microorganism.

Non-limiting examples of alcohol dehydrogenases include those encoded by sir1192 of *Synechocystis* sp. PCC6803 (SEQ ID NOS:104-105) and ACIAD3612 of *Acinetobacter baylyi* (SEQ ID NOS:106-107). Also included are homologs or paralogs thereof, functional equivalents thereof, and fragments or variants thereofs. Functional equivalents can include alcohol dehydrogenases with the ability to efficiently convert acyl aldehydes (e.g., $C_6$, $C_8$, $C_{10}$, $C_{12}$, $C_{14}$, $C_{16}$, $C_{18}$, $C_{20}$ aldehydes) into fatty alcohols. Specific examples of functional equivalents include long-chain alcohol dehydrogenases, having the ability to utilize long-chain aldehydes (e.g., $C_{16}$, $C_{18}$, $C_{20}$) as substrates.

In particular embodiments, the alcohol dehydrogenase has the amino acid sequence of SEQ ID NO:105 (encoded by the polynucleotide sequence of SEQ ID NO:104), or an active fragment or variant of this sequence. In some embodiments, the alcohol dehydrogenase has the amino acid sequence of SEQ ID NO:107 (encoded by the polynucleotide sequence of SEQ ID NO:106), or an active fragment or variant of this sequence.

Aldehyde Dehydrogenases.

Embodiments of the present disclosure optionally include one or more overexpressed or introduced aldehyde dehydrogenases. Examples of aldehyde dehydrogenases include enzymes capable of using acyl aldehydes (e.g., nonyl-aldehyde, C16 fatty aldehyde) as a substrate, and converting them into fatty acids. In certain embodiments, the aldehyde dehydrogenase is naturally-occurring or endogenous to the modified microorganism, and is sufficient to convert increased acyl aldehydes (produced by acyl-ACP reductase) into fatty acids, and thereby contribute to increased fatty acid production and overall satisfactory growth characteristics.

In certain embodiments, the aldehyde dehydrogenase can be overexpressed, for example, by recombinantly introducing a polynucleotide that encodes the enzyme, increasing expression of an endogenous enzyme, or both. An aldehyde dehydrogenase can be overexpressed in a strain that already expresses a naturally-occurring or endogenous enzyme, to further increase fatty acid production of an acyl-ACP reductase over-expressing strain and/or improve its growth characteristics, relative, for example, to an acyl-ACP reductase-overexpressing strain that only expresses endogenous aldehyde dehydrogenase. An aldehyde dehydrogenase can also be expressed or overexpressed in a strain that does not have a naturally occurring aldehyde dehydrogenase of that type, e.g., it does not naturally express an enzyme that is capable of efficiently converting acyl aldehydes such as nonyl-aldehyde into fatty acids.

In these and related embodiments, expression or overexpression of an aldehyde dehydrogenase may increase shunting of acyl aldehydes towards production of fatty acids, and away from production of other products such as alkanes. It may also reduce accumulation of potentially toxic acyl aldehydes, and thereby improve growth characteristics of a modified microorganism.

One exemplary aldehyde dehydrogenase is encoded by orf0489 of *Synechococcus elongatus* PCC7942. Also included are homologs or paralogs thereof, functional equivalents thereof, and fragments or variants thereof. Functional equivalents can include aldehyde dehydrogenases with the ability to efficiently convert acyl aldehydes (e.g., nonyl-aldehyde) into fatty acids. In certain embodiments, the aldehyde dehydrogenase has the amino acid sequence of SEQ ID NO:103 (encoded by the polynucleotide sequence of SEQ ID NO:102), or an active fragment or variant of this sequence.

Particular embodiments include photosynthetic microorganisms having reduced expression and/or activity of one or more aldehyde dehydrogenases, for instance, in the production of wax esters. Included are mutations (e.g., genomic) that reduce or eliminate the enzymatic activity of one or more endogenous aldehyde dehydrogenases, such as point mutations, insertions, or full or partial deletion mutations. Certain embodiments include a modified *Synechococcus elongatus* PCC7942 having a full or partial deletion of orf0489.

Aldehyde Decarbonylases.

Certain embodiments include photosynthetic microorganisms having reduced expression and/or activity of one or more aldehyde decarbonylases. As used herein, an "aldehyde decarbonylase" is capable of catalyzing the conversion of an acyl aldehyde (or fatty aldehyde) to an alkane or alkene. Included are members of the ferritin-like or ribonucleotide reductase-like family of nonheme diiron enzymes (see, e.g., Stubbe et al., *Trends Biochem Sci.* 23:438-43, 1998).

According to one non-limiting theory, because the aldehyde decarbonylase encoded by PCC7942_orf1593 (from *Synechococcus*) or PCC6803_orfsll0208 (from *Synechostis* sp. PCC6803) utilizes acyl aldehyde as a substrate for alkane or alkene production, reducing expression of this protein may further increase yields of free fatty acids by shunting acyl aldehydes (produced by acyl-ACP reductase) away from an alkane-producing pathway, and towards a fatty acid-producing pathway. PCC7942_orf1593 and PCC6803_orfsll0208 orthologs can be found, for example, in *N. punctiforme* PCC73102, Thermosynechococcus *elongatus* BP-1, *Synechococcus* sp. Ja-3-3AB, *P. marinus* MIT9313, *P. marinus* NATL2A, and *Synechococcus* sp. RS 9117, the latter having at least two paralogs (RS 9117-1 and -2).

Particular embodiments include mutations (e.g., genomic) that reduce or eliminate the enzymatic activity of one or more endogenous aldehyde decarbonylases, for instance, in the production of fatty acids or wax esters, optionally in combination with reduced expression of one or more endogenous aldehyde dehydrogenases. Also included are point mutations, insertions, and full or partial deletions of an endogenous gene encoding an aldehyde decarbonylase. Certain embodiments include a modified *Synechococcus elongatus* PCC7942 having a full or partial deletion of orf1593.

Thioesterases.

Certain embodiment include one or more exogenous or overexpressed thioesterase enzymes, optionally in combination with at least one of an introduced ACP enzyme, an introduced Aas enzyme, or both. For instance, one embodiment relates to the use an introduced ACP and/or Aas to increase the growth and/or fatty acid production of a free fatty acid producing TES strain, such as a TesA strain or a FatB strain (i.e., a strain having an introduced TesA or FatB). Thioesterases, as referred to herein, exhibit esterase activity (splitting of an ester into acid and alcohol, in the presence of water) specifically at a thiol group. Fatty acids are often attached to cofactor molecules, such as coenzyme A (CoA) and acyl carrier protein (ACP), by thioester linkages during the process of de novo fatty acid synthesis. Certain embodiments employ thioesterases having acyl-ACP thioesterase activity, acyl-CoA thioesterase activity, or both activities. Examples of thioesterases having both activities (i.e., acyl-ACP/acyl-CoA thioesterases) include TesA and related embodiments. In certain embodiments, a selected thioesterase has acyl-ACP thioesterase activity but not acyl-CoA thioesterase activity. Examples of thioesterases having only acyl-ACP thioesterase activity include the FatB thioesterases and related embodiments.

Certain thioesterases have both thioesterase activity and lysophospholipase activity. Specific examples of thioesterases include TesA, TesB, and related embodiments. Certain embodiments may employ periplasmically-localized or cytoplasmically-localized enzymes that thioesterase activity, such as *E. coli* TesA or *E. coli* TesB. For instance, wild type TesA, being localized to the periplasm, is normally used to hydrolyze thioester linkages of fatty acid-ACP (acyl-ACP) or fatty acid-CoA (acyl-CoA) compounds scavenged from the environment. A mutant thioesterase, PldC (referred to interchangeably as PldC/*TesA or *TesA), is not exported to the periplasm due to deletion of an N-terminal amino acid sequence required for proper transport of TesA from the cytoplasm to the periplasm. This deletion results in a cytoplasmic-localized PldC(*TesA) protein that has access to endogenous acyl-ACP and acyl-CoA intermediates. Other mutations or deletions in the N-terminal region of TesA can be used to achieve the same result, i.e., a cytoplasmic TesA.

Overexpressed PldC(*TesA) results in hydrolysis of acyl groups from endogenous acyl-ACP and acyl-CoA molecules. Cells expressing PldC(*TesA) must channel additional cellular carbon and energy to maintain production of acyl-ACP and acyl-coA molecules, which are required for membrane lipid synthesis. Thus, PldC(*TesA) expression results in a net increase in total cellular lipid content. For instance, PldC(*TesA) expressed alone in *Synechococcus* doubles the total lipid content from 10% of biomass to 20% of biomass, a result that can be further increased by combining *TesA or related molecules with an introduced ACP and/or an introduced Aas. Hence, certain embodiments employ an exogenous or overexpressed cytoplasmic TesA (such as *TesA) in combination with an exogenous or overexpressed ACP, an exogenous or overexpressed Aas, or both.

In certain embodiments, a thioesterase (TES) is an acyl-ACP thioesterase and/or an acyl-CoA thioesterase. In particular embodiments, the TES is a TesA or TesB polypeptide from *E. coli*, or a cytoplasmic TesA variant (*TesA) variant having the sequence set forth in SEQ ID NO:121, or a fragment or variant thereof.

Certain thioesterases have thioesterase activity only, i.e., they have little or no lysophospholipase activity. Examples of these thioesterases include enzymes of the FatB family. FatB encoded enzymes typically hydrolyze saturated C14-C18 ACPs, preferentially 16:0 ACP, but they can also hydrolyze 18:1 ACP. The production of medium chain (C8-C12) fatty acids in plants or seeds such as those of *Cuphea* spp. often results of FatB enzymes that have chain length specificities for medium chain fatty acyl-ACPs. These medium chain FatB thioesterases are present in many species with medium-chain fatty acids in their oil, including, for example, California bay laurel, coconut, and elm, among others. Hence, FatB sequences may be derived from these and other organisms. Particular examples include plant FatB acyl-ACP thioesterases such as C8, C12, C14, and C16 FatB thioesterases. Hence, in certain embodiments, the TES is a FatB polypeptide, such as a C8, C12, C14, C16, or C18 FatB.

Specific examples of FatB thioesterases include the *Cuphea hookeriana* C8/C10 FatB thioesterase, the *Umbellularia californica* C12 FatB1 thioesterase, the *Cinnamomum camphora* C14 FatB1 thioesterase, and the *Cuphea hookeriana* C16 FatB1 thioesterase. In specific embodiments, the thioesterase is a *Cuphea hookeriana* C8/C10 FatB, comprising the amino acid sequence of SEQ ID NO:108 (full-length protein) or SEQ ID NO:109 (mature protein without signal sequence). In particular embodiments, the thioesterase is a *Umbellularia californica* C12 FatB1, comprising the amino acid sequence of SEQ ID NO:110 (full-length protein) or SEQ ID NO:111 (mature protein without signal sequence). In certain embodiments, the thioesterase is a *Cinnamomum camphora* C14 FatB1, comprising the amino acid sequence of SEQ ID NO:112 (full-length protein) or SEQ ID NO:113 (mature protein without signal sequence). In particular embodiments, the thioesterase is a *Cuphea hookeriana* C16 FatB1, comprising the amino acid sequence of SEQ ID NO:114 (full-length protein) or SEQ ID NO:115 (mature protein without signal sequence).

Acetyl Coenzyme A Carboxylases (ACCase).

Embodiments of the present disclosure optionally include one or more exogenous (e.g., recombinantly introduced) or overexpressed ACCase proteins. As used herein, an "acetyl CoA carboxylase" gene includes any polynucleotide sequence encoding amino acids, such as protein, polypeptide or peptide, obtainable from any cell source, which demonstrates the ability to catalyze the carboxylation of acetyl-CoA to produce malonyl-CoA under enzyme reactive conditions, and further includes any naturally-occurring or non-naturally occurring variants of an acetyl-CoA carboxylase sequence having such ability.

Acetyl-CoA carboxylase (ACCase) is a biotin-dependent enzyme that catalyses the irreversible carboxylation of acetyl-CoA to produce malonyl-CoA through its two catalytic activities, biotin carboxylase (BC) and carboxyltransferase (CT). The biotin carboxylase (BC) domain catalyzes the first step of the reaction: the carboxylation of the biotin prosthetic group that is covalently linked to the biotin carboxyl carrier protein (BCCP) domain. In the second step of the reaction, the carboxyltransferase (CT) domain catalyzes the transfer of the carboxyl group from (carboxy) biotin to acetyl-CoA. Formation of malonyl-CoA by acetyl-CoA carboxylase (ACCase) represents the commitment step for fatty acid synthesis, because malonyl-CoA has no metabolic role other than serving as a precursor to fatty acids. Because of this reason, acetyl-CoA carboxylase represents a pivotal enzyme in the synthesis of fatty acids.

In most prokaryotes, ACCase is a multi-subunit enzyme, whereas in most eukaryotes it is a large, multi-domain enzyme. In yeast, the crystal structure of the CT domain of yeast ACCase has been determined at 2.7 A resolution (Zhang et al., *Science,* 299:2064-2067 (2003). This structure contains two domains, which share the same backbone fold. This fold belongs to the crotonase/ClpP family of proteins, with a b-b-a superhelix. The CT domain contains many insertions on its surface, which are important for the dimerization of ACCase. The active site of the enzyme is located at the dimer interface.

Although Cyanobacteria, such as *Synechococcus,* express a native ACCase enzyme, these bacteria typically do not produce or accumulate significant amounts of fatty acids. For example, *Synechococcus* in the wild accumulates fatty acids in the form of lipid membranes to a total of about 4% by dry weight.

Given the role of ACCase in the commitment step of fatty acid biosynthesis, embodiments of the present disclosure include methods of increasing the production of fatty acid biosynthesis, and, thus, lipid production, in Cyanobacteria by introducing one or more polynucleotides that encode an ACCase enzyme that is exogenous to the Cyanobacterium's native genome. Embodiments of the present disclosure also include a modified Cyanobacterium, and compositions comprising the Cyanobacterium, comprising one or more polynucleotides that encode an ACCase enzyme that is exogenous to the Cyanobacterium's native genome.

A polynucleotide encoding an ACCase enzyme may be isolated or obtained from any organism, such as any prokaryotic or eukaryotic organism that contains an endogenous ACCase gene. Examples of eukaryotic organisms having an ACCase gene are well-known in the art, and include various animals (e.g., mammals, fruit flies, nematodes), plants, parasites, and fungi (e.g., yeast such as *S. cerevisiae* and *Schizosaccharomyces pombe*). In certain embodiments, the ACCase encoding polynucleotide sequences are obtained from *Synechococcus* sp. PCC7002.

Examples of prokaryotic organisms that may be utilized to obtain a polynucleotide encoding an enzyme having ACCase activity include, but are not limited to, *Escherichia coli, Legionella pneumophila, Listeria monocytogenes, Streptococcus pneumoniae, Bacillus subtilis, Ruminococcus obeum* ATCC 29174, marine gamma proteobacterium HTCC2080, *Roseovarius* sp. HTCC2601, *Oceanicola granulosus* HTCC2516, *Bacteroides caccae* ATCC 43185, *Vibrio alginolyticus* 12G01, *Pseudoalteromonas tunicata* D2, *Marinobacter* sp. ELB17, marine gamma proteobacterium HTCC2143, *Roseobacter* sp. SK209-2-6, *Oceanicola batsensis* HTCC2597, *Rhizobium leguminosarum* bv. *trifolii* WSM1325, *Nitrobacter* sp. Nb-311A, *Chloroflexus aggregans* DSM 9485, *Chlorobaculum parvum, Chloroherpeton thalassium, Acinetobacter baumannii, Geobacillus,* and *Stenotrophomonas maltophilia,* among others.

Particular exemplary acetyl-CoA carboxylases (ACCase) comprise or consist of a polypeptide sequence set forth in any of SEQ ID NOs:55, 45, 46, 47, 48 or 49, or a fragment or variant thereof. SEQ ID NO:55 is the sequence of *Saccharomyces cerevisiae* acetyl-CoA carboxylase (yAcc1); SEQ ID NO:45 is *Synechococcus* sp. PCC 7002 AccA; SEQ ID NO:46 is *Synechococcus* sp. PCC 7002 AccB; SEQ ID NO:47 is *Synechococcus* sp. PCC 7002 AccC; and SEQ ID NO:48 is *Synechococcus* sp. PCC 7002 AccD; and SEQ ID NO:49 is a *Triticum aestivum* ACCase. In certain embodiments, the introduced ACCase is not native to the genome of the modified photosynthetic microorganism.

Phosphatidic Acid Phosphatases (PAP).

As used herein, a "phosphatidate phosphatase" or "phosphatidic acid phosphatase" gene includes any polynucleotide sequence encoding amino acids, such as protein, polypeptide or peptide, obtainable from any cell source, which demonstrates the ability to catalyze the dephosphorylation of phosphatidate (PtdOH) under enzyme reactive conditions, yielding diacylglycerol (DAG) and inorganic phosphate, and further includes any naturally-occurring or non-naturally occurring variants of a phosphatidate phosphatase sequence having such ability.

Phosphatidate phosphatases (PAP, 3-sn-phosphatidate phosphohydrolase) catalyze the dephosphorylation of phosphatidate (PtdOH), yielding diacylglycerol (DAG) and inorganic phosphate. This enzyme belongs to the family of hydrolases, specifically those acting on phosphoric monoester bonds. The systematic name of this enzyme class is 3-sn-phosphatidate phosphohydrolase. Other names in common use include phosphatic acid phosphatase, acid phosphatidyl phosphatase, and phosphatic acid phosphohydrolase. This enzyme participates in at least 4 metabolic pathways: glycerolipid metabolism, glycerophospholipid metabolism, ether lipid metabolism, and sphingolipid metabolism.

PAP enzymes have roles in both the synthesis of phospholipids and triacylglycerol through its product diacylglycerol, as well as the generation or degradation of lipid-signaling molecules in eukaryotic cells. PAP enzymes are typically classified as either $Mg^{2+}$-dependent (referred to as PAP1 enzymes) or $Mg^{2+}$-independent (PAP2 or lipid phosphate phosphatase (LPP) enzymes) with respect to their cofactor requirement for catalytic activity. In both yeast and mammalian systems, PAP2 enzymes are known to be involved in lipid signaling. By contrast, PAP1 enzymes, such as those found in *Saccharomyces cerevisiae*, play a role in de novo lipid synthesis (Han, et al. *J Biol Chem.* 281:

9210-9218, 2006), thereby revealing that the two types of PAP are responsible for different physiological functions.

In both yeast and higher eukaryotic cells, the PAP reaction is the committed step in the synthesis of the storage lipid triacylglycerol (TAG), which is formed from PtdOH through the intermediate DAG. The reaction product DAG is also used in the synthesis of the membrane phospholipids phosphatidylcholine (PtdCho) and phosphatidylethanolamine. The substrate PtdOH is used for the synthesis of all membrane phospholipids (and the derivative inositol-containing sphingolipids) through the intermediate CDP-DAG. Thus, regulation of PAP activity might govern whether cells make storage lipids and phospholipids through DAG or phospholipids through CDP-DAG. In addition, PAP is involved in the transcriptional regulation of phospholipid synthesis.

PAP1 enzymes have been purified and characterized from the membrane and cytosolic fractions of yeast, including a gene (Pah1, formerly known as Smp2) been identified to encode a PAP1 enzyme in *S. cerevisiae*. The Pah1-encoded PAP1 enzyme is found in the cytosolic and membrane fractions of the cell, and its association with the membrane is peripheral in nature. As expected from the multiple forms of PAP1 that have been purified from yeast, pah1Δ mutants still contain PAP1 activity, indicating the presence of an additional gene or genes encoding enzymes having PAP1 activity.

Analysis of mutants lacking the Pah1-encoded PAP1 has provided evidence that this enzyme generates the DAG used for lipid synthesis. Cells containing the pah1Δ mutation accumulate PtdOH and have reduced amounts of DAG and its acylated derivative TAG. Phospholipid synthesis predominates over the synthesis of TAG in exponentially growing yeast, whereas TAG synthesis predominates over the synthesis of phospholipids in the stationary phase of growth. The effects of the pah1Δ mutation on TAG content are most evident in the stationary phase. For example, stationary phase cells devoid of the Pah1 gene show a reduction of >90% in TAG content. Likewise, the pah1Δ mutation shows the most marked effects on phospholipid composition (e.g. the consequent reduction in PtdCho content) in the exponential phase of growth. The importance of the Pah1-encoded PAP1 enzyme to cell physiology is further emphasized because of its role in the transcriptional regulation of phospholipid synthesis.

The requirement of $Mg^{2+}$ ions as a cofactor for PAP enzymes is correlated with the catalytic motifs that govern the phosphatase reactions of these enzymes. For example, the Pah1-encoded PAP1 enzyme has a DxDxT (SEQ ID NO:198) catalytic motif within a haloacid dehalogenase (HAD)-like domain ("x" is any amino acid). This motif is found in a superfamily of $Mg^{2+}$-dependent phosphatase enzymes, and its first aspartate residue is responsible for binding the phosphate moiety in the phosphatase reaction. By contrast, the DPP1- and LPP1-encoded PAP2 enzymes contain a three-domain lipid phosphatase motif that is localized to the hydrophilic surface of the membrane. This catalytic motif, which comprises the consensus sequences KxxxxxxRP (domain 1) (SEQ ID NO:116), PSGH (domain 2) (SEQ ID NO:117), and SRxxxxxHxxxD (domain 3) (SEQ ID NO:118), is shared by a superfamily of lipid phosphatases that do not require $Mg^{2+}$ ions for activity. The conserved arginine residue in domain 1 and the conserved histidine residues in domains 2 and 3 may be essential for the catalytic activity of PAP2 enzymes. Accordingly, a phosphatidate phosphatase polypeptide may comprise one or more of the above-described catalytic motifs.

A polypeptide having a phosphatidate phosphatase enzymatic activity may be obtained from any organism having a suitable, endogenous phosphatidate phosphatase gene. Examples of organisms that may be used to obtain a phosphatidate phosphatase encoding polynucleotide sequence include, but are not limited to, *Homo sapiens, Mus musculus, Rattus norvegicus, Bos taurus, Drosophila melanogaster, Arabidopsis thaliana, Magnaporthe grisea, Saccharomyces cerevisiae, Schizosaccharomyces pombe, Cryptococcus neoformans*, and *Bacillus pumilus*, among others. Specific examples of PAP enzymes include Pah1 from *S. cerevisiae*, PgpB from *E. coli*, and PAP from PCC6803.

In certain embodiments, a phosphatidate phosphatase polypeptide comprises or consists of a polypeptide sequence set forth in SEQ ID NO:131, or a fragment or variant thereof. SEQ ID NO:131 is the sequence of *Saccharomyces cerevisiae* phosphatidate phosphatase (yPah1). In certain embodiments, the polypeptide sequence of the PAP is encoded by the *E. coli* PgpB gene, and/or the PAP gene from *Synechocystis* sp. PCC6803.

Triacylglycerol (TAG) Hydrolases.

Certain embodiments relate to the use of exogenous or overexpressed TAG hydrolases (or TAG lipases) to increase production of TAGs in a TAG-producing strain. For instance, certain embodiments may utilize a TAG hydrolase in combination with a DGAT, and optionally a TES. These embodiments may then further utilize an ACP, an Aas, or both, any of the lipid biosynthesis proteins described herein, and/or any of the modifications to glycogen production and storage described herein. Hence, as noted above, TAG hydrolases may be used in TAG-producing strains (e.g., DGAT-expressing strains) with or without an ACP or Aas.

TAG hydrolases are carboxylesterases that are typically specific for insoluble long chain fatty acid TAGs. Carboxylesterases catalyze the chemical reaction:

carboxylic ester+$H_2O$⇌alcohol+carboxylate

Thus, the two substrates of this enzyme are carboxylic ester and $H_2O$, whereas its two products are alcohol and carboxylate. According to one non-limiting theory, it is understood that TAG hydrolase expression (or overexpression) in a TAG producing strain (e.g., DGAT/ACP, DGAT/Aas, DGAT/ACP/Aas) releases acyl chains to not only increase accumulation of free fatty acids (FFA), but also increase the amount of free 1, 2 diacylglycerol (DAG). This free DAG then serves as a substrate for DGAT, and thereby allows increased TAG production, especially in the presence of over-expressed ACP, Aas, or both. Accordingly, certain embodiments employing a TAG hydrolase produce increased amounts of TAG, relative, for example, to a DGAT only-expressing microorganism. In certain embodiments, the TAG hydrolase is specific for TAG and not DAG, i.e., it preferentially acts on TAG relative to DAG.

Non-limiting examples of TAG hydrolases include SDP1 (SUGAR-DEPENDENT1) triacylglycerol lipase from *Arabidopsis thaliana* (SEQ ID NO:170), ACIAD1335 from *Acinetobacter* sp. ADP1 (SEQ ID NO:171), TG14P from *S. cerevisiae* (SEQ ID NO:172), and RHA1_ro04722 (YP_704665) TAG lipase from *Rhodococcus* (SEQ ID NO:173). Additional putative lipases/esterases from *Rhodococcus* include RHA1_ro01602 lipase/esterase (see SEQ ID NOs:156 and 174 for polynucleotide and polypeptide sequence, respectively), and RHA1_ro06856 lipase/esterase (see SEQ ID NOs:119 and 120 for polynucleotide and polypeptide sequence, respectively).

Fatty Acyl-CoA Synthetases.

Certain embodiments relate to the use of overexpressed fatty acyl-CoA synthetases to increase activation of fatty acids, and thereby increase production of TAGs in a TAG-producing strain (e.g., a DGAT-expressing strain). For instance, certain embodiments may utilize an acyl-ACP reductase in combination with a fatty acyl-CoA synthetase and a DGAT. These embodiments may then further utilize an ACP, an ACCase, or both, and/or any of the modifications to glycogen production and storage or glycogen breakdown described herein.

Fatty acyl-CoA synthetases activate fatty acids for metabolism by catalyzing the formation of fatty acyl-CoA thioesters. Fatty acyl-CoA thioesters can then serve not only as substrates for beta-oxidation, at least in bacteria capable of growing on fatty acids as a sole source of carbon (e.g., *E. coli, Salmonella*), but also as acyl donors in phospholipid biosynthesis. Many fatty acyl-CoA synthetases are characterized by two highly conserved sequence elements, an ATP/AMP binding motif, which is common to enzymes that form an adenylated intermediate, and a fatty acid binding motif.

According to one non-limiting theory, certain embodiments may employ fatty acyl-CoA synthetases to increase activation of free fatty acids, which can then be incorporated into TAGs, mainly by the DGAT-expressing (and thus TAG-producing) photosynthetic microorganisms described herein. Hence, fatty acyl-CoA synthetases can be used in any of the embodiments described herein, such as those that produce increased levels of free fatty acids, where it is desirable to turn free fatty acids into TAGs. As noted above, these free fatty acids can then be activated by fatty acyl-CoA synthetases to generate acyl-CoA thioesters, which can then serve as substrates by DGAT to produce increased levels of TAGs.

One exemplary fatty acyl-CoA synthetase includes the FadD gene from *E. coli* (SEQ ID NOS:16 and 17 for nucleotide and polypeptide sequence, respectively), which encodes a fatty acyl-CoA synthetase having substrate specificity for medium and long chain fatty acids. Other exemplary fatty acyl-CoA synthetases include those derived from *S. cerevisiae*; Faa1p can use C12-C16 acyl-chains in vitro (see SEQ ID NOS:18 and 19 for nucleotide and polypeptide sequence, respectively), Faa2p shows a less restricted specificity ranging from C7-C17 (see SEQ ID NOS:20 and 21 for nucleotide and polypeptide sequence, respectively), and Faa3p, together with that of DGAT1, enhances lipid accumulation in the presence of exogenous fatty acids in *S. cerevisiae* (see SEQ ID NO:22 and 23 for nucleotide and polypeptide sequence, respectively). SEQ ID NO:22 is codon-optimized for expression in *S. elongatus* PCC7942.

Lipases/Phospholipases.

In various embodiments, modified photosynthetic microorganisms, e.g., Cyanobacteria, of the present disclosure further comprise one or more exogenous or introduced nucleic acids that encode a polypeptide having a lipase or phospholipase activity, or a fragment or variant thereof. Lipases, including phospholipases, lysophospholipases, thioesterases, and enzymes having one, two, or all three of these activities, typically catalyze the hydrolysis of ester chemical bonds in lipid substrates. Without wishing to be bound by any one theory, in certain exemplary embodiments the expression of one or more phospholipases can generate fatty acids from membrane lipids, which may then be used by the ACP and/or Aas to make acyl-ACPs. These acyl-ACPs, for example, can then feed into the triglyceride synthesis pathways, thereby increasing triglyceride (TAG) production.

A phospholipase is an enzyme that hydrolyzes phospholipids into fatty acids and other lipophilic substances. There are four major classes, termed A, B, C and D distinguished by what type of reaction they catalyze. Phospholipase A1 cleaves the SN-1 acyl chain, while Phospholipase A2 cleaves the SN-2 acyl chain, releasing arachidonic acid. Phospholipase B cleaves both SN-1 and SN-2 acyl chains, and is also known as a lysophospholipase. Phospholipase C cleaves before the phosphate, releasing diacylglycerol and a phosphate-containing head group. Phospholipases C play a central role in signal transduction, releasing the second messenger, inositol triphosphate. Phospholipase D cleaves after the phosphate, releasing phosphatidic acid and an alcohol. Types C and D are considered phosphodiesterases. In various embodiments, one or more phospholipase from any one of these classes may be used, alone or in any combination.

As noted above, phospholipases (PLA1,2) act on phospholipids of different kinds including phosphatidyl glycerol, the major phospholipid in Cyanobacteria, by cleaving the acyl chains off the sn1 or sn2 positions (carbon 1 or 2 on the glycerol backbone); some are selective for sn1 or sn2, others act on both. Lysophospholipases act on lysophospholipids, which can be the product of phospholipases or on lysophosphatidic acid, a normal intermediate of the de novo phosphatidic acid synthesis pathway, e.g., 1-acyl-DAG-3-phosphate.

Merely by way of non-limiting theory, it is understood that in certain embodiments, phospholipases and/or lysophospholipases can cleave off acyl chains from phospholipids or lysophospholipids and thus deregulate the normal recycling of the lipid membranes, including both cell membrane and thylakoid membranes, which then leads to accumulation of free fatty acids (FFAs). In certain embodiments (e.g., TesA strains), these FFAs may accumulate extracellularly. In other embodiments (e.g., ACP and/or Aas overexpressing microorganisms), FFAs can be converted into acyl-ACPs by acyl ACP synthase (Aas) in a strain that also over-expresses ACP. In certain embodiments (e.g., DGAT-containing microorganisms), these acyl-ACPs can then serve as substrates for DGAT to make TAGs.

In other embodiments, phospholipases can be over-expressed to generate lyshophospholipids and acyl chains. The lysophospholipids can then serve as substrates for a lysophospholipase, which cleaves off the remaining acyl chain. In some embodiments, these acyl chains can either accumulate as FFAs, or in other embodiments may serve as substrates of Acyl ACP synthase (Aas) to generate acyl-ACPs, which can then be used by DGAT to make TAGs.

Particular examples of phospholipase C enzymes include those derived from eukaryotes such as mammals and parasites, in addition to those derived from bacteria. Examples include phosphoinositide phospholipase C (EC 3.1.4.11), the main form found in eukaryotes, especially mammals, the zinc-dependent phospholipase C family of bacterial enzymes (EC 3.1.4.3) that includes alpha toxins, phosphatidylinositol diacylglycerol-lyase (EC 4.6.1.13), a related bacterial enzyme, and glycosylphosphatidylinositol diacylglycerol-lyase (EC 4.6.1.14), a trypanosomal enzyme.

In particular embodiments, the present disclosure contemplates using a lysophospholipase. A lysophospholipase is an enzyme that catalyzes the chemical reaction:

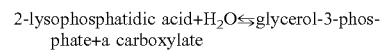

Thus, the two substrates of this enzyme are 2-lysophosphatidylcholine and $H_2O$, whereas its two products are glycerophosphocholine and carboxylate.

Lysophospholipase are members of the hydrolase family, specifically those acting on carboxylic ester bonds. Lysophospholipases participate in glycerophospholipid metabolism. Examples of lysophospholipases include, but are not limited to, 2-Lysophosphatidylcholine acylhydrolase, Lecithinase B, Lysolecithinase, Phospholipase B, Lysophosphatidase, Lecitholipase, Phosphatidase B, Lysophosphatidylcholine hydrolase, Lysophospholipase A1, Lysophospholipase L1 (TesA), Lysophopholipase L2, TesB, Lysophospholipase transacylase, Neuropathy target esterase, NTE, NTE-LysoPLA, NTE-lysophospholipase, and Vu Patatin 1 protein. In particular embodiments, lysophospholipases utilized according to the present disclosure are derived from a bacteria, e.g., E. coli, or a plant. Any of these lysophospholipases may be used according to various embodiments of the present invention.

Certain lysophospholipases, such as Lysophospholipase L1 (also referred to as PldC or TesA) are periplasmically-localized or cytoplasmically-localized enzymes that have both lysophospholipase and thioesterase activity, as described above. Hence, certain thioesterases such as TesA can also be characterized as lysophospholipases. A mutant lysophospholipase described herein, PldC(*TesA), is not exported to the periplasm due to deletion of an N-terminal amino acid sequence required for proper transport of TesA from the cytoplasm to the periplasm. This results in a cytoplasmic-localized PldC(*TesA) protein that has access to endogenous acyl-ACP and acyl-CoA intermediates. Overexpressed PldC(*TesA) results in hydrolysis of acyl groups from endogenous acyl-ACP and acyl-CoA molecules. Cells expressing PldC(*TesA) must channel additional cellular carbon and energy to maintain production of acyl-ACP and acyl-coA molecules, which are required for membrane lipid synthesis. Thus, PldC(*TesA) expression results in a net increase in cellular lipid content. As described herein, PldC(*TesA) is expressed in Synechococcus lipid content doubles from 10% of biomass to 20% of biomass.

In certain embodiments, lysophospholipases utilized according to the present disclosure have both phospholipase and thioesterase activities. Examples of lysophospholipases that have both activities include, e.g., Lysophospholipase L1 (TesA), such as E. coli Lysophospholipase L1, as well as fragments and variants thereof, including those described in the paragraph above. As a phospholipase, certain embodiments may employ TesA variants having only lysophospholipase activity, including variants with reduced or no thioesterase activity.

In particular embodiments, the phospholipase is a bacterial phospholipase, e.g., lysophospholipase, or a fragment or variant thereof, e.g., a phospholipase derived from Escherichia coli, S. cerevisiae, Rhodococcus, Streptomyces or Acinetobacter species.

Additional non-limiting examples of phospholipases include phospholipase A1 (PldA) from Acinetobacter sp. ADP1, phospholipase A (PldA) from E. coli, phospholipase from Streptomyces coelicolor A3(2), phospholipase A2 (PLA2-α) from Arabidopsis thaliana; phospholipase A1/triacylglycerol lipase (DAD1; Defective Anther Dehiscence 1) from Arabidopsis thaliana, chloroplast DONGLE from Arabidopsis thaliana, patatin-like protein from Arabidopsis thaliana, and patatin from Anabaena variabilis ATCC 29413. Additional non-limiting examples of lysophospholipases include phospholipase B (Plb1p) from Saccharomyces cerevisiae S288c, phospholipase B (Plb2p) from Saccharomyces cerevisiae S288c, ACIAD1057 (tesA homolog) from Acinetobacter ADP1, ACIAD1943 lysophospholipase from Acinetobacter ADP1, and a lysophospholipase (YP_702320; RHA1_ro02357) from Rhodococcus.

In particular embodiments, the encoded phospholipase comprises or consists of a Lysophospholipase L1 (TesA), Lysophospholipase L2, TesB, or Vu patatin 1 protein, or a homolog, fragment, or variant thereof. In certain embodiments, the Lysophospholipase L1 (TesA), Lysophospholipase L2, or TesB is a bacterial Lysophospholipase L1 (TesA), Lysophospholipase L2, or TesB, such as an E. coli Lysophospholipase L1 (TesA) having the wild-type sequence set forth in SEQ ID NO:133, an E. coli Lysophospholipase L2 having the wild-type sequence set forth in SEQ ID NO:137, or an E. coli TesB having the wild-type sequence set forth in SEQ ID NO:134. In particular embodiment, the Vu patatin 1 protein has the wild-type sequence set forth in SEQ ID NO:138.

In particular embodiments, the phospholipase is modified such that it localizes predominantly to the cytoplasm instead of the periplasm. For example, the phospholipase may have a deletion or mutation in a region associated with periplasmic localization. In particular embodiments, the phospholipase variant is derived from Lysophospholipase L1 (TesA) or TesB. In certain embodiments, the Lysophospholipase L1 (TesA) or TesB variant is a bacterial Lysophospholipase L1 (TesA) or TesB variant, such as a cytoplasmic E. coli Lysophospholipase L1 (PldC(*TesA)) variant having the sequence set forth in SEQ ID NO:121.

Additional examples of phospholipase polypeptide sequences include phospholipase A1 (PldA) from Acinetobacter sp. ADP1 (SEQ ID NO:157), phospholipase A (PldA) from E. coli (SEQ ID NO:158), phospholipase from Streptomyces coelicolor A3(2) (SEQ ID NO:159), phospholipase A2 (PLA2-α) from Arabidopsis thaliana (SEQ ID NO:160). phospholipase A1/triacylglycerol lipase (DAD1; Defective Anther Dehiscence 1) from Arabidopsis thaliana (SEQ ID NO:161), chloroplast DONGLE from Arabidopsis thaliana (SEQ ID NO:162), patatin-like protein from Arabidopsis thaliana (SEQ ID NO:163), and patatin from Anabaena variabilis ATCC 29413 (SEQ ID NO:164). Additional non-limiting examples of lysophospholipase polypeptide sequences include phospholipase B (Plb1p) from Saccharomyces cerevisiae S288c (SEQ ID NO:165), phospholipase B (Plb2p) from Saccharomyces cerevisiae S288c (SEQ ID NO:166), ACIAD1057 (TesA homolog) from Acinetobacter ADP1 (SEQ ID NO:167), ACIAD1943 lysophospholipase from Acinetobacter ADP1 (SEQ ID NO:168), and a lysophospholipase (YP_702320; RHA1_ro02357) from Rhodococcus (SEQ ID NO:169).

Fatty Acyl Reductase.

Certain embodiments relate to the use of overexpressed fatty acyl reductases to increase synthesis of fatty alcohols, and thereby increase production of wax esters in a WE-producing strain (e.g., a DGAT-expressing strain). For instance, certain embodiments may utilize a fatty acyl reductase, possibly in combination with an acyl-ACP reductase, and a DGAT. These embodiments may then further utilize an ACP, an ACCase, or both, and/or any of the modifications to glycogen production and storage or glycogen breakdown described herein.

Fatty Acyl Reductases catalyze the two step reduction of acyl-ACP's or acyl-COA's to acyl alcohols, also known as fatty alcohols. The first step proceeds via an acyl aldehyde intermediate, which is then converted in a second step to a fatty alcohol. These same enzymes can also directly reduce fatty aldehydes to fatty alcohols (i.e. step two only). In this case they are sometimes referred to as fatty aldehyde reductases. Fatty alcohols can serve as a substrate for wax ester biosynthesis by a DGAT. Many fatty acyl reductases are characterized by three conserved sequence elements. There is an NADPH binding motif, a motif characteristic of the catalytic site of NADP-utilizing enzymes, and a conserved C-terminal domain, referred to as the Male Sterile 2 domain, that is of unknown function (see Hofvander et al., FEBS Letters (2011) pp 3583-3543)

According to one non-limiting theory, certain embodiments may employ fatty acyl reductases to increase synthesis of fatty alcohols, which can then be incorporated into WE's, mainly by the DGAT-expressing (and thus WE-producing) photosynthetic microorganisms described herein. Hence, fatty acyl reductases can be used in any of the embodiments described herein, such as those that produce increased levels of free fatty alcohols, where it is desirable to turn these into WE's. As noted above, these free fatty alcohols can then be esterified to fatty acids (in the form of acyl-ACP) by DGATs to generate WE's.

One exemplary fatty acyl reductase includes a gene from *Marinobacter aquaeolei* VT8, genbank accession number YP_959769.1 (see SEQ ID NOs:224 and 225 for polypeptide and polynucleotide sequence, respectively). Others include a gene from *Simmondsia chinesis* (Jojoba) AF149917 (see SEQ ID NOs:226 and 227 for polypeptide and polynucleotide sequence, respectively); a gene from *Euglena gracilis* GU733919 (see SEQ ID NOs:228 and 229 for polypeptide and polynucleotide sequence, respectively); a gene from *Hahella chejuensis* YP 436183 (see SEQ ID NOs:230 and 231 for polypeptide and polynucleotide sequence, respectively); a gene from *Photobacterium profundum* SS9 YP 130411.1 (see SEQ ID NOs:232 and 233 for polypeptide and polynucleotide sequence, respectively); a gene from *Marinobacter algicola* DG893 ZP 01892457 (see SEQ ID NOs:234 and 235 for polypeptide and polynucleotide sequence, respectively); a gene from *Marinobacter adhaerens* HP15 ADP96574 (see SEQ ID NOs:236 and 237 for polypeptide and polynucleotide sequence, respectively); a gene from *Arabidopsis thaliana* CERF NM 119537 (see SEQ ID NOs:238 and 239 for polypeptide and polynucleotide sequence, respectively); a gene from *Arabidopsis thaliana* At3g56700 NC 003074 (see SEQ ID NOs:240 and 241 for polypeptide and polynucleotide sequence, respectively); a gene from *Arabidopsis thaliana* Atg22500 NC 003076 (see SEQ ID NOs:242 and 243 for polypeptide and polynucleotide sequence, respectively); and a gene from *Triticum aestivum* (Wheat bread) AJ459250 (see SEQ ID NOs:244 and 245 for polypeptide and polynucleotide sequence, respectively).

(iii) Glycogen Synthesis, Storage, and Breakdown

In particular embodiments, a modified photosynthetic microorganism further comprises additional modifications, such that it has reduced expression of one or more genes associated with a glycogen synthesis or storage pathway and/or increased expression of one or more polynucleotides that encode a protein associated with a glycogen breakdown pathway, or a functional variant of fragment thereof.

In various embodiments, modified photosynthetic microorganisms, e.g., Cyanobacteria, of the present disclosure have reduced expression of one or more genes associated with glycogen synthesis and/or storage. In particular embodiments, these modified photosynthetic microorganisms have a mutated or deleted gene associated with glycogen synthesis and/or storage. In particular embodiments, these modified photosynthetic microorganisms comprise a vector that includes a portion of a mutated or deleted gene, e.g., a targeting vector used to generate a knockout or knockdown of one or more alleles of the mutated or deleted gene. In certain embodiments, these modified photosynthetic microorganisms comprise an antisense RNA or siRNA that binds to an mRNA expressed by a gene associated with glycogen synthesis and/or storage.

In certain embodiments, modified photosynthetic microorganisms, e.g., Cyanobacteria, of the present disclosure comprise one or more exogenous or introduced nucleic acids that encode a polypeptide having an activity associated with a glycogen breakdown or triglyceride or fatty acid biosynthesis, including but not limited to any of those described herein. In particular embodiments, the exogenous nucleic acid does not comprise a nucleic acid sequence that is native to the microorganism's genome. In particular embodiments, the exogenous nucleic acid comprises a nucleic acid sequence that is native to the microorganism's genome, but it has been introduced into the microorganism, e.g., in a vector or by molecular biology techniques, for example, to increase expression of the nucleic acid and/or its encoded polypeptide in the microorganism.

Glycogen Biosynthesis and Storage.

Glycogen is a polysaccharide of glucose, which functions as a means of carbon and energy storage in most cells, including animal and bacterial cells. More specifically, glycogen is a very large branched glucose homopolymer containing about 90% α-1,4-glucosidic linkages and 10% α-1,6 linkages. For bacteria in particular, the biosynthesis and storage of glycogen in the form of α-1,4-polyglucans represents an important strategy to cope with transient starvation conditions in the environment.

Glycogen biosynthesis involves the action of several enzymes. For instance, bacterial glycogen biosynthesis occurs generally through the following general steps: (1) formation of glucose-1-phosphate, catalyzed by phosphoglucomutase (Pgm), followed by (2) ADP-glucose synthesis from ATP and glucose 1-phosphate, catalyzed by glucose-1-phosphate adenylyltransferase (GlgC), followed by (3) transfer of the glucosyl moiety from ADP-glucose to a pre-existing α-1,4 glucan primer, catalyzed by glycogen synthase (GlgA). This latter step of glycogen synthesis typically occurs by utilizing ADP-glucose as the glucosyl donor for elongation of the α-1,4-glucosidic chain.

In bacteria, the main regulatory step in glycogen synthesis takes place at the level of ADP-glucose synthesis, or step (2) above, the reaction catalyzed by glucose-1-phosphate adenylyltransferase (GlgC), also known as ADP-glucose pyrophosphorylase (see, e.g., Ballicora et al., *Microbiology and Molecular Biology Reviews* 6:213-225, 2003). In contrast, the main regulatory step in mammalian glycogen synthesis occurs at the level of glycogen synthase. As shown herein, by altering the regulatory and/or other active components in the glycogen synthesis pathway of photosynthetic microorganisms such as Cyanobacteria, and thereby reducing the biosynthesis and storage of glycogen, the carbon that would have otherwise been stored as glycogen can be utilized by the photosynthetic microorganism to synthesize other carbon-based storage molecules, such as lipids, fatty acids, and triglycerides.

Therefore, certain modified photosynthetic microorganisms, e.g., Cyanobacteria, of the present disclosure may comprise a mutation, deletion, or any other alteration that disrupts one or more of these steps (i.e., renders the one or more steps "non-functional" with respect to glycogen biosynthesis and/or storage), or alters any one or more of the enzymes directly involved in these steps, or the genes encoding them. As noted above, such modified photosynthetic microorganisms, e.g., Cyanobacteria, are typically capable of producing and/or accumulating an increased amount of lipids, such as fatty acids, as compared to a wild type photosynthetic microorganism. Certain exemplary glycogen biosynthesis genes are described below.

Phosphoglucomutase Gene (Pgm).

In one embodiment, a modified photosynthetic microorganism, e.g., a Cyanobacteria, expresses a reduced amount of the phosphoglucomutase gene. In particular embodiments, it may comprise a mutation or deletion in the phosphoglucomutase gene, including any of its regulatory elements (e.g., promoters, enhancers, transcription factors, positive or negative regulatory proteins, etc.). Phosphoglucomutase (Pgm), encoded by the gene pgm, catalyzes the reversible transformation of glucose 1-phosphate into glucose 6-phosphate, typically via the enzyme-bound intermediate, glucose 1,6-biphosphate (see, e.g., Lu et al., *Journal of Bacteriology* 176:5847-5851, 1994). Although this reaction is reversible, the formation of glucose-6-phosphate is markedly favored.

However, typically when a large amount of glucose-6-phosphate is present, Pgm catalyzes the phosphorylation of the 1-carbon and the dephosphorylation of the c-carbon, resulting in glucose-1-phosphate. The resulting glucose-1-phosphate is then converted to UDP-glucose by a number of intermediate steps, including the catalytic activity of GlgC, which can then be added to a glycogen storage molecule by the activity of glycogen synthase, described below. Thus, under certain conditions, the Pgm enzyme plays an intermediary role in the biosynthesis and storage of glycogen.

The pgm gene is expressed in a wide variety of organisms, including most, if not all, Cyanobacteria. The pgm gene is also fairly conserved among Cyanobacteria, as can be appreciated upon comparison of SEQ ID NOs:24 (*S. elongatus* PCC7942), 25 (*Synechocystis* sp. PCC6803), and 26 (*Synechococcus* sp. WH8102), 79 (*Synechococcus* RCC307), and 80 (*Synechococcus* 7002), which provide the polynucleotide sequences of various pgm genes from Cyanobacteria.

Deletion of the pgm gene in Cyanobacteria, such as *Synechococcus*, has been demonstrated herein for the first time to reduce the accumulation of glycogen in the Cyanobacteria, and also to increase the production of other carbon-based products, such as lipids and fatty acids.

Glucose-1-Phosphate Adenylyltransferase (glgC).

In one embodiment, a modified photosynthetic microorganism, e.g., a Cyanobacteria, expresses a reduced amount of a glucose-1-phosphate adenylyltransferase (glgC) gene. In certain embodiments, it may comprise a mutation or deletion in the glgC gene, including any of its regulatory elements. The enzyme encoded by the glgC gene (e.g., EC 2.7.7.27) participates generally in starch, glycogen and sucrose metabolism by catalyzing the following chemical reaction:

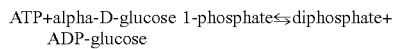

Thus, the two substrates of this enzyme are ATP and alpha-D-glucose 1-phosphate, whereas its two products are diphosphate and ADP-glucose. The glgC-encoded enzyme catalyzes the first committed and rate-limiting step in starch biosynthesis in plants and glycogen biosynthesis in bacteria. It is the enzymatic site for regulation of storage polysaccharide accumulation in plants and bacteria, being allosterically activated or inhibited by metabolites of energy flux.

The enzyme encoded by the glgC gene belongs to a family of transferases, specifically those transferases that transfer phosphorus-containing nucleotide groups (i.e., nucleotidyltransferases). The systematic name of this enzyme class is typically referred to as ATP:alpha-D-glucose-1-phosphate adenylyltransferase. Other names in common use include ADP glucose pyrophosphorylase, glucose 1-phosphate adenylyltransferase, adenosine diphosphate glucose pyrophosphorylase, adenosine diphosphoglucose pyrophosphorylase, ADP-glucose pyrophosphorylase, ADP-glucose synthase, ADP-glucose synthetase, ADPG pyrophosphorylase, and ADP:alpha-D-glucose-1-phosphate adenylyltransferase.

The glgC gene is expressed in a wide variety of plants and bacteria, including most, if not all, Cyanobacteria. The glgC gene is also fairly conserved among Cyanobacteria, as can be appreciated upon comparison of SEQ ID NOs:27 (*S. elongatus* PCC7942), 28 (*Synechocystis* sp. PCC6803), 29 (*Synechococcus* sp. PCC 7002), 30 (*Synechococcus* sp. WH8102), 31 (*Synechococcus* sp. RCC 307), 32 (*Trichodesmium erythraeum* IMS 101), 33 (*Anabaena varibilis*), and 34 (*Nostoc* sp. PCC 7120), which describe the polynucleotide sequences of various glgC genes from Cyanobacteria.

Deletion of the glgC gene in Cyanobacteria, such as *Synechococcus*, reduces the accumulation of glycogen in the Cyanobacteria, and increases the production of other carbon-based products, such as lipids and fatty acids.

Glycogen Synthose (glgA).

In one embodiment, a modified photosynthetic microorganism, e.g., a Cyanobacteria, expresses a reduced amount of a glycogen synthase gene. In particular embodiments, it may comprise a deletion or mutation in the glycogen synthase gene, including any of is regulatory elements. Glycogen synthase (GlgA), also known as UDP-glucose-glycogen glucosyltransferase, is a glycosyltransferase enzyme that catalyses the reaction of UDP-glucose and (1,4-α-D-glucosyl)$_n$ to yield UDP and (1,4-α-D-glucosyl)$_{n+1}$. Glycogen synthase is an α-retaining glucosyltransferase that uses ADP-glucose to incorporate additional glucose monomers onto the growing glycogen polymer. Essentially, GlgA catalyzes the final step of converting excess glucose residues one by one into a polymeric chain for storage as glycogen.

Classically, glycogen synthases, or α-1,4-glucan synthases, have been divided into two families, animal/fungal glycogen synthases and bacterial/plant starch synthases, according to differences in sequence, sugar donor specificity and regulatory mechanisms. However, detailed sequence analysis, predicted secondary structure comparisons, and threading analysis show that these two families are structurally related and that some domains of animal/fungal synthases were acquired to meet the particular regulatory requirements of those cell types.

Crystal structures have been established for certain bacterial glycogen synthases (see, e.g., Buschiazzo et al., *The EMBO Journal* 23, 3196-3205, 2004). These structures show that reported glycogen synthase folds into two Rossmann-fold domains organized as in glycogen phosphorylase and other glycosyltransferases of the glycosyltransferases superfamily, with a deep fissure between both domains that includes the catalytic center. The core of the N-terminal domain of this glycogen synthase consists of a nine-stranded, predominantly parallel, central β-sheet flanked on both sides by seven α-helices. The C-terminal domain (residues 271-456) shows a similar fold with a six-stranded parallel β-sheet and nine α-helices. The last α-helix of this domain undergoes a kink at position 457-460, with the final 17 residues of the protein (461-477) crossing over to the N-terminal domain and continuing as α-helix, a typical feature of glycosyltransferase enzymes.

These structures also show that the overall fold and the active site architecture of glycogen synthase are remarkably similar to those of glycogen phosphorylase, the latter playing a central role in the mobilization of carbohydrate reserves, indicating a common catalytic mechanism and comparable substrate-binding properties. In contrast to glycogen phosphorylase, however, glycogen synthase has a much wider catalytic cleft, which is predicted to undergo an important interdomain 'closure' movement during the catalytic cycle.

Crystal structures have been established for certain GlgA enzymes (see, e.g., Jin et al., *EMBO J* 24:694-704, 2005, incorporated by reference). These studies show that the N-terminal catalytic domain of GlgA resembles a dinucleotide-binding Rossmann fold and the C-terminal domain adopts a left-handed parallel beta helix that is involved in cooperative allosteric regulation and a unique oligomerization. Also, communication between the regulator-binding sites and the active site involves several distinct regions of the enzyme, including the N-terminus, the glucose-1-phosphate-binding site, and the ATP-binding site.

The glgA gene is expressed in a wide variety of cells, including animal, plant, fungal, and bacterial cells, including most, if not all, Cyanobacteria. The glgA gene is also fairly conserved among Cyanobacteria, as can be appreciated upon comparison of SEQ ID NOs:35 (*S. elongatus* PCC7942), 36 (*Synechocystis* sp. PCC6803), 37 (*Synechococcus* sp. PCC 7002), 38 (*Synechococcus* sp. WH8102), 39 (*Synechococcus* sp. RCC 307), 40 (*Trichodesmium erythraeum* IMS 101), 41 (*Anabaena variabilis*), and 42 (*Nostoc* sp. PCC 7120), which describe the polynucleotide sequences of various glgA genes from Cyanobacteria.

Glycogen Breakdown.

In certain embodiments, a modified photosynthetic microorganism of the present disclosure expresses an increased amount of one or more polypeptides associated with a glycogen breakdown pathway. In particular embodiments, the one or more polypeptides include glycogen phosphorylase (GlgP), glycogen isoamylase (GlgX), glucanotransferase (MalQ), phosphoglucomutase (Pgm), glucokinase (Glk), and/or phosphoglucose isomerase (Pgi), or a functional fragment or variant thereof, including, for example, those provided in SEQ ID NOs:68, 70, 72, 73, 83 or 85. Examples of additional Pgm polypeptide sequences useful according to the present disclosure are provided in SEQ ID NOs:74, 76, 77, 79, and 81. Pgm, Glk, and Pgi are bidirectional enzymes that can promote glycogen synthesis or breakdown depending on conditions.

(iv) Polypeptide Variants and Fragments

As noted above, embodiments of the present disclosure include variants and fragments of any of the reference polypeptides and polynucleotides described herein (see, e.g., the Sequence Listing). Variant polypeptides are biologically active, that is, they continue to possess the enzymatic activity of a reference polypeptide. Such variants may result from, for example, genetic polymorphism and/or from human manipulation.

Biologically active variants of a reference polypeptide will have at least 40%, 50%, 60%, 70%, generally at least 75%, 80%, 85%, usually about 90% to 95% or more, and typically about 97% or 98% or more sequence similarity or sequence identity to the amino acid sequence for a reference protein as determined by sequence alignment programs described elsewhere herein using default parameters. A biologically active variant of a reference polypeptide may differ from that protein generally by as much 200, 100, 50 or 20 amino acid residues or suitably by as few as 1-15 amino acid residues, as few as 1-10, such as 6-10 amino acid residues, including about 20, 19, 18, 17, 16, 15, 14, 13, 12, 11, 10, 9, 8, 7, 6, 5, 4, 3, 2, or even 1 amino acid residues. In some embodiments, a variant polypeptide differs from the reference sequences referred to herein (see, e.g., the Sequence Listing) by at least one but by less than 15, 10 or 5 amino acid residues. In other embodiments, it differs from the reference sequences by at least one residue but less than 20%, 15%, 10% or 5% of the residues.

A biologically active fragment can be a polypeptide fragment which is, for example, 10, 11, 12, 13, 14, 15, 16, 17, 18, 19, 20, 21, 22, 23, 24, 25, 26, 27, 28, 29, 30, 40, 50, 60, 70, 80, 90, 100, 110, 120, 130, 140, 150, 160, 170, 180, 190, 200, 220, 240, 260, 280, 300, 320, 340, 360, 380, 400, 450, 500, 600 or more contiguous amino acids, including all integers in between, of a reference polypeptide sequence.

A reference polypeptide may be altered in various ways including amino acid substitutions, deletions, truncations, and insertions. Methods for such manipulations are generally known in the art. For example, amino acid sequence variants of a reference polypeptide can be prepared by mutations in the DNA. Methods for mutagenesis and nucleotide sequence alterations are well known in the art. See, for example, Kunkel (*PNAS USA.* 82: 488-492, 1985); Kunkel et al., (*Methods in Enzymol.* 154: 367-382, 1987), U.S. Pat. No. 4,873,192, Watson, J. D. et al., ("Molecular Biology of the Gene," Fourth Edition, Benjamin/Cummings, Menlo Park, Calif., 1987) and the references cited therein. Guidance as to appropriate amino acid substitutions that do not affect biological activity of the protein of interest may be found in the model of Dayhoff et al., (1978) Atlas of Protein Sequence and Structure (Natl. Biomed. Res. Found., Washington, D.C.).

Methods for screening gene products of combinatorial libraries made by point mutations or truncation, and for screening cDNA libraries for gene products having a selected property are known in the art. Such methods are adaptable for rapid screening of the gene libraries generated by combinatorial mutagenesis of reference polypeptides. Recursive ensemble mutagenesis (REM), a technique which enhances the frequency of functional mutants in the libraries, can be used in combination with the screening assays to identify polypeptide variants (Arkin and Yourvan, *PNAS USA* 89: 7811-7815, 1992; Delgrave et al., *Protein Engineering.* 6: 327-331, 1993). Conservative substitutions, such as exchanging one amino acid with another having similar properties, may be desirable as discussed in more detail below.

Polypeptide variants may contain conservative amino acid substitutions at various locations along their sequence, as compared to a reference amino acid sequence. A "conservative amino acid substitution" is one in which the amino acid residue is replaced with an amino acid residue having a similar side chain. Families of amino acid residues having similar side chains have been defined in the art, which can be generally sub-classified as follows:

Acidic: The residue has a negative charge due to loss of H ion at physiological pH and the residue is attracted by aqueous solution so as to seek the surface positions in the conformation of a peptide in which it is contained when the peptide is in aqueous medium at physiological pH. Amino acids having an acidic side chain include glutamic acid and aspartic acid.

Basic: The residue has a positive charge due to association with H ion at physiological pH or within one or two pH units thereof (e.g., histidine) and the residue is attracted by aqueous solution so as to seek the surface positions in the conformation of a peptide in which it is contained when the peptide is in aqueous medium at physiological pH. Amino acids having a basic side chain include arginine, lysine and histidine.

Charged: The residues are charged at physiological pH and, therefore, include amino acids having acidic or basic side chains (i.e., glutamic acid, aspartic acid, arginine, lysine and histidine).

Hydrophobic: The residues are not charged at physiological pH and the residue is repelled by aqueous solution so as to seek the inner positions in the conformation of a peptide in which it is contained when the peptide is in aqueous medium. Amino acids having a hydrophobic side chain include tyrosine, valine, isoleucine, leucine, methionine, phenylalanine and tryptophan.

Neutral/polar: The residues are not charged at physiological pH, but the residue is not sufficiently repelled by aqueous solutions so that it would seek inner positions in the conformation of a peptide in which it is contained when the peptide is in aqueous medium. Amino acids having a neutral/polar side chain include asparagine, glutamine, cysteine, histidine, serine and threonine.

This description also characterizes certain amino acids as "small" since their side chains are not sufficiently large, even if polar groups are lacking, to confer hydrophobicity. With the exception of proline, "small" amino acids are those with four carbons or less when at least one polar group is on the side chain and three carbons or less when not. Amino acids having a small side chain include glycine, serine, alanine and threonine. The gene-encoded secondary amino acid proline is a special case due to its known effects on the secondary conformation of peptide chains. The structure of proline differs from all the other naturally-occurring amino acids in that its side chain is bonded to the nitrogen of the α-amino group, as well as the α-carbon. Several amino acid similarity matrices (e.g., PAM120 matrix and PAM250 matrix as disclosed for example by Dayhoff et al., (1978), A model of evolutionary change in proteins. Matrices for determining distance relationships In M. O. Dayhoff, (ed.), Atlas of protein sequence and structure, Vol. 5, pp. 345-358, National Biomedical Research Foundation, Washington D.C.; and by Gonnet et al., (Science. 256: 14430-1445, 1992), however, include proline in the same group as glycine, serine, alanine and threonine. Accordingly, for the purposes of the present invention, proline is classified as a "small" amino acid.

The degree of attraction or repulsion required for classification as polar or nonpolar is arbitrary and, therefore, amino acids specifically contemplated by the disclosure have been classified as one or the other. Most amino acids not specifically named can be classified on the basis of known behaviour.

Amino acid residues can be further sub-classified as cyclic or non-cyclic, and aromatic or non-aromatic, self-explanatory classifications with respect to the side-chain substituent groups of the residues, and as small or large. The residue is considered small if it contains a total of four carbon atoms or less, inclusive of the carboxyl carbon, provided an additional polar substituent is present; three or less if not. Small residues are, of course, always non-aromatic. Dependent on their structural properties, amino acid residues may fall in two or more classes. For the naturally-occurring protein amino acids, sub-classification according to this scheme is presented in Table A.

TABLE A

Amino acid sub-classification

| Sub-classes | Amino acids |
| --- | --- |
| Acidic | Aspartic acid, Glutamic acid |
| Basic | Noncyclic: Arginine, Lysine; Cyclic: Histidine |
| Charged | Aspartic acid, Glutamic acid, Arginine, Lysine, Histidine |
| Small | Glycine, Serine, Alanine, Threonine, Proline |
| Polar/neutral | Asparagine, Histidine, Glutamine, Cysteine, Serine, Threonine |
| Polar/large | Asparagine, Glutamine |
| Hydrophobic | Tyrosine, Valine, Isoleucine, Leucine, Methionine, Phenylalanine, Tryptophan |
| Aromatic | Tryptophan, Tyrosine, Phenylalanine, |
| Residues that influence chain orientation | Glycine and Proline |

Conservative amino acid substitution also includes groupings based on side chains. For example, a group of amino acids having aliphatic side chains is glycine, alanine, valine, leucine, and isoleucine; a group of amino acids having aliphatic-hydroxyl side chains is serine and threonine; a group of amino acids having amide-containing side chains is asparagine and glutamine; a group of amino acids having aromatic side chains is phenylalanine, tyrosine, and tryptophan; a group of amino acids having basic side chains is lysine, arginine, and histidine; and a group of amino acids having sulphur-containing side chains is cysteine and methionine. For example, it is reasonable to expect that replacement of a leucine with an isoleucine or valine, an aspartate with a glutamate, a threonine with a serine, or a similar replacement of an amino acid with a structurally related amino acid will not have a major effect on the properties of the resulting variant polypeptide. Whether an amino acid change results in a functional truncated and/or variant polypeptide can readily be determined by assaying its enzymatic activity, as described herein. Conservative substitutions are shown in Table B under the heading of exemplary substitutions. Amino acid substitutions falling within the scope of the invention, are, in general, accomplished by selecting substitutions that do not differ significantly in their effect on maintaining (a) the structure of the peptide backbone in the area of the substitution, (b) the charge or hydrophobicity of the molecule at the target site, or (c) the bulk of the side chain. After the substitutions are introduced, the variants are screened for biological activity.

TABLE B

Exemplary Amino Acid Substitutions

| Original Residue | Exemplary Substitutions | Preferred Substitutions |
| --- | --- | --- |
| Ala | Val, Leu, Ile | Val |
| Arg | Lys, Gln, Asn | Lys |
| Asn | Gln, His, Lys, Arg | Gln |
| Asp | Glu | Glu |
| Cys | Ser | Ser |
| Gln | Asn, His, Lys, | Asn |
| Glu | Asp, Lys | Asp |
| Gly | Pro | Pro |
| His | Asn, Gln, Lys, Arg | Arg |
| Ile | Leu, Val, Met, Ala, Phe, Norleu | Leu |
| Leu | Norleu, Ile, Val, Met, Ala, Phe | Ile |
| Lys | Arg, Gln, Asn | Arg |
| Met | Leu, Ile, Phe | Leu |
| Phe | Leu, Val, Ile, Ala | Leu |

TABLE B-continued

Exemplary Amino Acid Substitutions

| Original Residue | Exemplary Substitutions | Preferred Substitutions |
|---|---|---|
| Pro | Gly | Gly |
| Ser | Thr | Thr |
| Thr | Ser | Ser |
| Trp | Tyr | Tyr |
| Tyr | Trp, Phe, Thr, Ser | Phe |
| Val | Ile, Leu, Met, Phe, Ala, Norleu | Leu |

Alternatively, similar amino acids for making conservative substitutions can be grouped into three categories based on the identity of the side chains. The first group includes glutamic acid, aspartic acid, arginine, lysine, histidine, which all have charged side chains; the second group includes glycine, serine, threonine, cysteine, tyrosine, glutamine, asparagine; and the third group includes leucine, isoleucine, valine, alanine, proline, phenylalanine, tryptophan, methionine, as described in Zubay, G., *Biochemistry*, third edition, Wm. C. Brown Publishers (1993).

Thus, a predicted non-essential amino acid residue in reference polypeptide is typically replaced with another amino acid residue from the same side chain family. Alternatively, mutations can be introduced randomly along all or part of a coding sequence, such as by saturation mutagenesis, and the resultant mutants can be screened for an activity of the parent polypeptide to identify mutants which retain that activity. Following mutagenesis of the coding sequences, the encoded peptide can be expressed recombinantly and the activity of the peptide can be determined. A "non-essential" amino acid residue is a residue that can be altered from the wild-type sequence of an embodiment polypeptide without abolishing or substantially altering one or more of its activities. Suitably, the alteration does not substantially abolish one of these activities, for example, the activity is at least 20%, 40%, 60%, 70% or 80% 100%, 500%, 1000% or more of wild-type. An "essential" amino acid residue is a residue that, when altered from the wild-type sequence of a reference polypeptide, results in abolition of an activity of the parent molecule such that less than 20% of the wild-type activity is present. For example, such essential amino acid residues may include those that are conserved in reference polypeptides across different species, including those sequences that are conserved in the enzymatic sites of reference polypeptides from various sources.

Accordingly, the present disclosure also contemplates variants of the naturally-occurring reference polypeptide sequences or their biologically-active fragments, wherein the variants are distinguished from the naturally-occurring sequence by the addition, deletion, or substitution of one or more amino acid residues. In general, as noted above, variants will display at least about 30, 40, 50, 55, 60, 65, 70, 75, 80, 85, 90, 91, 92, 93, 94, 95, 96, 97, 98, 99% similarity or sequence identity to a reference polypeptide sequence. Moreover, sequences differing from the native or parent sequences by the addition, deletion, or substitution of 1, 2, 3, 4, 5, 6, 7, 8, 9, 10, 11, 12, 13, 14, 15, 16, 17, 18, 19, 20, 30, 40, 50, 60, 70, 80, 90, 100 or more amino acids but which retain the properties or activities of a parent or reference polypeptide sequence are contemplated.

In some embodiments, variant polypeptides differ from reference sequence by at least one but by less than 50, 40, 30, 20, 15, 10, 8, 6, 5, 4, 3 or 2 amino acid residue(s). In other embodiments, variant polypeptides differ from a reference sequence by at least 1% but less than 20%, 15%, 10% or 5% of the residues. (If this comparison requires alignment, the sequences should be aligned for maximum similarity. "Looped" out sequences from deletions or insertions, or mismatches, are considered differences.)

Calculations of sequence similarity or sequence identity between sequences (the terms are used interchangeably herein) are performed as follows. To determine the percent identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In certain embodiments, the length of a reference sequence aligned for comparison purposes is at least 30%, preferably at least 40%, more preferably at least 50%, 60%, and even more preferably at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide as the corresponding position in the second sequence, then the molecules are identical at that position.

The percent identity between the two sequences is a function of the number of identical positions shared by the sequences, taking into account the number of gaps, and the length of each gap, which need to be introduced for optimal alignment of the two sequences.

The comparison of sequences and determination of percent identity between two sequences can be accomplished using a mathematical algorithm. In a preferred embodiment, the percent identity between two amino acid sequences is determined using the Needleman and Wunsch, (*J. Mol. Biol.* 48: 444-453, 1970) algorithm which has been incorporated into the GAP program in the GCG software package, using either a Blossum 62 matrix or a PAM250 matrix, and a gap weight of 16, 14, 12, 10, 8, 6, or 4 and a length weight of 1, 2, 3, 4, 5, or 6. In yet another preferred embodiment, the percent identity between two nucleotide sequences is determined using the GAP program in the GCG software package, using a NWSgapdna.CMP matrix and a gap weight of 40, 50, 60, 70, or 80 and a length weight of 1, 2, 3, 4, 5, or 6. A particularly preferred set of parameters (and the one that should be used unless otherwise specified) are a Blossum 62 scoring matrix with a gap penalty of 12, a gap extend penalty of 4, and a frameshift gap penalty of 5.

The percent identity between two amino acid or nucleotide sequences can be determined using the algorithm of E. Meyers and W. Miller (*Cabios.* 4:11-17, 1989) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al., (1990, *J. Mol. Biol*, 215: 403-10). BLAST nucleotide searches can be performed with the NBLAST program, score=100, wordlength=12 to obtain nucleotide sequences homologous to nucleic acid molecules of the invention. BLAST protein searches can be performed with the XBLAST program, score=50, wordlength=3 to obtain amino acid sequences homologous to protein molecules of the invention. To obtain gapped alignments for comparison purposes, Gapped BLAST can be utilized as described in Altschul et al., (*Nucleic Acids Res.* 25: 3389-3402, 1997). When utilizing BLAST and Gapped BLAST programs, the default parameters of the respective programs (e.g., XBLAST and NBLAST) can be used.

In one embodiment, as noted above, polynucleotides and/or polypeptides can be evaluated using a BLAST alignment tool. A local alignment consists simply of a pair of sequence segments, one from each of the sequences being compared. A modification of Smith-Waterman or Sellers algorithms will find all segment pairs whose scores cannot be improved by extension or trimming, called high-scoring segment pairs (HSPs). The results of the BLAST alignments include statistical measures to indicate the likelihood that the BLAST score can be expected from chance alone.

The raw score, S, is calculated from the number of gaps and substitutions associated with each aligned sequence wherein higher similarity scores indicate a more significant alignment. Substitution scores are given by a look-up table (see PAM, BLOSUM).

Gap scores are typically calculated as the sum of G, the gap opening penalty and L, the gap extension penalty. For a gap of length n, the gap cost would be G+Ln. The choice of gap costs, G and L is empirical, but it is customary to choose a high value for G (10-15), e.g., 11, and a low value for L (1-2) e.g., 1.

The bit score, S', is derived from the raw alignment score S in which the statistical properties of the scoring system used have been taken into account. Bit scores are normalized with respect to the scoring system, therefore they can be used to compare alignment scores from different searches. The terms "bit score" and "similarity score" are used interchangeably. The bit score gives an indication of how good the alignment is; the higher the score, the better the alignment.

The E-Value, or expected value, describes the likelihood that a sequence with a similar score will occur in the database by chance. It is a prediction of the number of different alignments with scores equivalent to or better than S that are expected to occur in a database search by chance. The smaller the E-Value, the more significant the alignment. For example, an alignment having an E value of $e^{-117}$ means that a sequence with a similar score is very unlikely to occur simply by chance. Additionally, the expected score for aligning a random pair of amino acids is required to be negative, otherwise long alignments would tend to have high score independently of whether the segments aligned were related. Additionally, the BLAST algorithm uses an appropriate substitution matrix, nucleotide or amino acid and for gapped alignments uses gap creation and extension penalties. For example, BLAST alignment and comparison of polypeptide sequences are typically done using the BLOSUM62 matrix, a gap existence penalty of 11 and a gap extension penalty of 1.

In one embodiment, sequence similarity scores are reported from BLAST analyses done using the BLOSUM62 matrix, a gap existence penalty of 11 and a gap extension penalty of 1.

In a particular embodiment, sequence identity/similarity scores provided herein refer to the value obtained using GAP Version 10 (GCG, Accelrys, San Diego, Calif.) using the following parameters: % identity and % similarity for a nucleotide sequence using GAP Weight of 50 and Length Weight of 3, and the nwsgapdna.cmp scoring matrix; % identity and % similarity for an amino acid sequence using GAP Weight of 8 and Length Weight of 2, and the BLOSUM62 scoring matrix (Henikoff and Henikoff, *PNAS USA*. 89:10915-10919, 1992). GAP uses the algorithm of Needleman and Wunsch (*J Mol Biol*. 48:443-453, 1970) to find the alignment of two complete sequences that maximizes the number of matches and minimizes the number of gaps.

In one particular embodiment, the variant polypeptide comprises an amino acid sequence that can be optimally aligned with a reference polypeptide sequence (see, e.g., Sequence Listing) to generate a BLAST bit scores or sequence similarity scores of at least about 50, 60, 70, 80, 90, 100, 100, 110, 120, 130, 140, 150, 160, 170, 180, 190, 200, 210, 220, 230, 240, 250, 260, 270, 280, 290, 300, 310, 320, 330, 340, 350, 360, 370, 380, 390, 400, 410, 420, 430, 440, 450, 460, 470, 480, 490, 500, 510, 520, 530, 540, 550, 560, 570, 580, 590, 600, 610, 620, 630, 640, 650, 660, 670, 680, 690, 700, 710, 720, 730, 740, 750, 760, 770, 780, 790, 800, 810, 820, 830, 840, 850, 860, 870, 880, 890, 900, 910, 920, 930, 940, 950, 960, 970, 980, 990, 1000, or more, including all integers and ranges in between, wherein the BLAST alignment used the BLOSUM62 matrix, a gap existence penalty of 11, and a gap extension penalty of 1.

Variants of a reference polypeptide can be identified by screening combinatorial libraries of mutants of a reference polypeptide. Libraries or fragments e.g., N terminal, C terminal, or internal fragments, of protein coding sequence can be used to generate a variegated population of fragments for screening and subsequent selection of variants of a reference polypeptide.

Methods for screening gene products of combinatorial libraries made by point mutation or truncation, and for screening cDNA libraries for gene products having a selected property are known in the art. Such methods are adaptable for rapid screening of the gene libraries generated by combinatorial mutagenesis of polypeptides.

The present disclosure also contemplates the use of chimeric or fusion proteins of the reference polypeptides described herein. As used herein, a "chimeric protein" or "fusion protein" includes a reference polypeptide, or a polypeptide fragment linked to either another reference polypeptide (e.g., to create multiple fragments), to a non-reference polypeptide, or to both. In certain embodiments, a reference polypeptide can be fused to a heterologous polypeptide sequence. A "heterologous polypeptide" typically has an amino acid sequence corresponding to a protein which is different from the reference protein sequence, and which can be derived from the same or a different organism. The reference polypeptide of the fusion protein can correspond to all or a portion of a biologically active amino acid sequence.

In certain embodiments, a fusion protein includes at least one or two biologically active portions of reference protein. The polypeptides forming the fusion protein are typically linked C-terminus to N-terminus, although they can also be linked C-terminus to C-terminus, N-terminus to N-terminus, or N-terminus to C-terminus. The polypeptides of the fusion protein can be in any order.

The fusion partner may be designed and included for essentially any desired purpose provided they do not adversely affect the enzymatic activity of the polypeptide. For example, in one embodiment, a fusion partner may comprise a sequence that assists in expressing the protein (an expression enhancer) at higher yields than the native recombinant protein. Other fusion partners may be selected so as to increase the solubility or stability of the protein or to enable the protein to be targeted to desired intracellular compartments.

The fusion protein can include a moiety which has a high affinity for a ligand. For example, the fusion protein can be a GST-fusion protein in which the reference polypeptide sequences are fused to the C-terminus of the GST sequences. Such fusion proteins can facilitate the purification and/or identification of the resulting polypeptide. Alternatively, the fusion protein can be reference polypeptide containing a heterologous signal sequence at its N-terminus. In certain host cells, expression and/or secretion of such proteins can be increased through use of a heterologous signal sequence.

Fusion proteins may generally be prepared using standard techniques, described elsewhere herein. A peptide linker sequence may be employed to separate the first and second polypeptide components by a distance sufficient to ensure that each polypeptide folds into its secondary and tertiary structures, if desired. Exemplary peptide linkers are described elsewhere herein.

Polynucleotides and Vectors

Embodiments of the present disclosure include polynucleotides encoding a diacylglycerol acyltransferase (DGAT) fusion protein described herein, the fusion protein comprising at least one DGAT polypeptide fused to at least one intracellular localization domain, such as a bacteria membrane- or bacterial plasma membrane (PM)-targeting domain. Such polynucleotides can be partially or fully isolated from other cellular components, within a vector, for example, a composition comprising such a vector (e.g., in a tube or kit), or in a host cell, such as modified photosynthetic microorganism.

These polynucleotides and modified photosynthetic microorganisms comprising the same may optionally comprise one or more (introduced) polynucleotides encoding a lipid biosynthesis protein, and/or one or more (introduced) polynucleotides encoding a polypeptide associated with glycogen breakdown.

Also included are nucleotide sequences that encode any functional naturally-occurring variants or fragments (e.g., allelic variants, orthologs, splice variants) or non-naturally occurring variants or fragments of these native polynucleotides (i.e., optimized by engineering), as well as compositions comprising such polynucleotides, including, for example, cloning and expression vectors.

Also, the modified photosynthetic microorganisms described herein may optionally comprise a mutation or deletion in one or more genes associated with glycogen biosynthesis or storage, alone or in combination with the presence of overexpressed proteins associated with lipid biosynthesis proteins and/or glycogen breakdown. Certain modified photosynthetic microorganisms, for example, for the production of wax esters, may optionally comprise a mutation or deletion in or more genes encoding an aldehyde decarbonylase, an aldehyde dehydrogenase, or both, either alone or in combination with the presence of overexpressed proteins associated with lipid biosynthesis proteins and/or glycogen breakdown.

The recitations "mutation" or "deletion," in this context refer generally to those changes or alterations in a photosynthetic microorganism, e.g., a Cyanobacterium, that render the product of that gene non-functional or having reduced function. Examples of such changes or alterations include nucleotide substitutions, deletions, or additions/insertions to the coding or regulatory sequences of a targeted gene (e.g., glgA, glgC, pgm, aldehyde decarbonylase, aldehyde dehydrogenase), in whole or in part, which disrupt, eliminate, down-regulate, or significantly reduce the expression of the polypeptide encoded by that gene, whether at the level of transcription, translation, post-translational modification, or protein stability. Such alterations can also reduce the enzymatic activity or other functional characteristic of the protein (e.g., localization), with or without reducing expression.

Techniques for producing such alterations or changes, such as by recombination with a vector having a selectable marker, are exemplified herein and known in the molecular biological art. In particular embodiments, one or more alleles of a gene, e.g., two or all alleles, may be mutated or deleted within a photosynthetic microorganism. In particular embodiments, modified photosynthetic microorganisms, e.g., Cyanobacteria, of the present disclosure are merodiploids or partial diploids.

The "deletion" of a targeted gene or polypeptide may also be accomplished by targeting the mRNA of that gene, such as by using various antisense technologies (e.g., antisense oligonucleotides and siRNA) known in the art. Accordingly, targeted genes may be considered "non-functional" when the polypeptide or enzyme encoded by that gene is not expressed by the modified photosynthetic microorganism, or is expressed in negligible amounts.

As used herein, the terms "DNA" and "polynucleotide" and "nucleic acid" include a DNA molecule that has been isolated free of total genomic DNA of a particular species. Therefore, a DNA segment encoding a polypeptide refers to a DNA segment that contains one or more coding sequences yet is substantially isolated away from, or purified free from, total genomic DNA of the species from which the DNA segment is obtained. Included within the terms "DNA segment" and "polynucleotide" are DNA segments and smaller fragments of such segments, and also recombinant vectors, including, for example, plasmids, cosmids, phagemids, phage, viruses, and the like.

As will be understood by those skilled in the art, the polynucleotide sequences of this disclosure can include genomic sequences, extra-genomic and plasmid-encoded sequences and smaller engineered gene segments that express, or may be adapted to express, proteins, polypeptides, peptides and the like. Such segments may be naturally isolated, or modified synthetically by the hand of man.

Polynucleotides may be single-stranded (coding or antisense) or double-stranded, and may be DNA (genomic, cDNA or synthetic) or RNA molecules. Additional coding or non-coding sequences may, but need not, be present within a polynucleotide of the present invention, and a polynucleotide may, but need not, be linked to other molecules and/or support materials.

Polynucleotides may comprise a native sequence (e.g., an endogenous sequence that encodes protein described herein) or may comprise a variant or fragment, or a biological functional equivalent of such a sequence. Polynucleotide variants may contain one or more substitutions, additions, deletions and/or insertions, as further described herein, preferably such that the enzymatic activity of the encoded polypeptide is not substantially diminished relative to the unmodified or reference polypeptide. The effect on the enzymatic activity of the encoded polypeptide may generally be assessed as described herein and known in the art.

(i) Intracellular Localization Domain-DGAT Fusion Polynucleotides

Embodiments of the present disclosure include polynucleotides (e.g., isolated polynucleotides) that encode any of the intracellular localization domain-DGAT fusion proteins described herein, such as the membrane-targeting domain-DGAT fusion proteins. These polynucleotides comprise at least one sequence encoding a heterologous intracellular localization domain described herein, which is fused in-frame to at least one sequence encoding a DGAT polypeptide, or an active fragment or variant thereof.

Certain embodiments thus include polynucleotides that encode any one or more of the intracellular localization domains described herein, where such polynucleotide(s) are fused in-frame to a DGAT-encoding polynucleotide. Exemplary sequences that encode a membrane-targeting domain can be found within SEQ ID NOs:200 or 202, the respective PCC7942-0858 and PCC7942-1015 coding sequences of two methyl-accepting chemotaxis (MCP) proteins from *S. elongatus*. For instance, in certain embodiments, the polynucleotide sequence may include about the N-terminal 129 nucleotides of SEQ ID NO:200 (PCC7942-0858), which encodes the leader sequence of the MCP protein encoded by the PCC7942-0858 gene; additional sequences can also be included, for instance, about the N-terminal 132, 135, 138, 141, 144, 147, 150, 153, 156, 159, 162, 165, 168, 171, 174, 177, 180 or more nucleotides of SEQ ID NO:200 (PCC7942-0858).

Also included are polynucleotides that encode any one or more of the DGAT polypeptides described herein, where such polynucleotide(s) are fused in-frame to a heterologous intracellular localization domain-encoding polynucleotide. In certain embodiments, a DGAT-encoding portion of the fusion protein encodes a DGAT comprising or consisting of a polypeptide sequence set forth in any one of SEQ ID NOs:58, 59, 60 or 61, or a fragment or variant thereof. SEQ ID NO:58 is the sequence of DGATn; SEQ ID NO: 59 is the sequence of *Streptomyces coelicolor* DGAT (ScoDGAT or SDGAT); SEQ ID NO:60 is the sequence of *Alcanivorax borkumensis* DGAT (AboDGAT); and SEQ ID NO:61 is the sequence of DGATd (*Acinetobacter baylii* sp.).

In certain embodiments, a DGAT-encoding portion of the fusion protein comprises or consists of a polynucleotide sequence set forth in any one of SEQ ID NOs:62, 63, 64, 65 or 66, or a fragment or variant thereof. SEQ ID NO:62 is a codon-optimized for expression in Cyanobacteria sequence that encodes DGATn; SEQ ID NO:63 has homology to SEQ ID NO:62; SEQ ID NO:64 is a codon-optimized for expression in Cyanobacteria sequence that encodes ScoDGAT; SEQ ID NO:65 is a codon-optimized for expression in Cyanobacteria sequence that encodes AboDGAT; and SEQ ID NO:66 is a codon-optimized for expression in Cyanobacteria sequence that encodes DGATd. DGATn and DGATd correspond to *Acinetobacter baylii* DGAT and a modified form thereof, which includes two additional amino acid residues immediately following the initiator methionine.

(ii) Lipid Biosynthesis Genes

In certain embodiments, a modified photosynthetic microorganism comprises an introduced polynucleotide that encodes one or more lipid biosynthesis proteins. In some instances, a modified photosynthetic microorganism comprises an endogenous polynucleotide that encodes a lipid biosynthesis gene, where a regulatory element such as a promoter is introduced upstream of that polynucleotide to regulate or alter expression of the encoded protein.

In particular embodiments, a modified photosynthetic microorganism comprises reduced or eliminated expression or activity of a lipid biosynthesis polypeptide. Included are full or partial deletions, and point mutations or insertions of an endogenous lipid biosynthesis gene that reduce or eliminate expression and/or activity of the encoded polypeptide.

Exemplary lipid biosynthesis genes encode polypeptides such as acyl carrier proteins (ACP), acyl ACP synthases (Aas), acyl-ACP reductases, alcohol dehydrogenases, aldehyde dehydrogenases, aldehyde decarbonylases, thioesterases (TES), acetyl coenzyme A carboxylases (ACCase), phosphatidic acid phosphatases (PAP; or phosphatidate phosphatases), triacylglycerol (TAG) hydrolases, fatty acyl-CoA synthetases, and lipases/phospholipases, as described herein.

Acyl Carrier Proteins.

In certain embodiments, a modified photosynthetic microorganism comprises one or more polynucleotides encoding one or more acyl carrier proteins (ACP). Exemplary ACP nucleotide sequences include SEQ ID NO:5 from *Synechococcus elongatus* PCC7942, SEQ ID NOS:7, 9, and 11 from *Acinetobacter* sp. ADP1, and SEQ ID NO:13 from *Spinacia oleracea*.

Acyl ACP Synthases (Aas).

In certain embodiments, a modified photosynthetic microorganism comprises one or more polynucleotides encoding one or more acyl-ACP synthetase (Aas) enzymes. In certain embodiments, the Aas nucleotide sequence is derived from the Se918 gene of *Synechococcus elongatus*. One exemplary Aas sequence nucleotide sequence is SEQ ID NO:43 from *Synechococcus elongatus* PCC 7942.

In particular embodiments, a modified photosynthetic microorganism of the present disclosure has a mutation such as a point mutation, insertion, or full or partial deletion of one or more endogenous Aas genes, for instance, the Se918 gene of *S. elongatus* PCC7942, to reduce or eliminate expression and/or activity of the encoded Aas polypeptide.

Acyl-ACP Reductases.

In certain embodiments, a modified photosynthetic microorganism comprises one or more polynucleotides encoding one or more acyl-ACP reductase polypeptides. Exemplary acyl-ACP reductase nucleotide sequences include orf1594 from *Synechococcus elongatus* PCC7942 (SEQ ID NO:1), and orfsll0209 from *Synechocystis* sp. PCC6803 (SEQ ID NO:3).

Alcohol Dehydrogenases.

Certain embodiments may employ one or more alcohol dehydrogenase encoding polynucleotide sequences. Exemplary alcohol dehydrogenases include sir1192 of *Synechocystis* sp. PCC6803 (SEQ ID NO:104) and ACIAD3612 from *Acinetobacter baylii* (SEQ ID NO:106).

Aldehyde Dehydrogenases.

Certain embodiments may employ one or more aldehyde dehydrogenase encoding polynucleotide sequences. Certain embodiments, for example, for the production of triglycerides or wax esters, may comprise mutations such as point mutations, insertions, or full or partial deletions of one or more endogenous aldehyde dehydrogenase genes. One exemplary aldehyde dehydrogenase is orf0489 of *Synechococcus elongatus* PCC7942 (SEQ ID NO:102).

Aldehyde Decarbonylases.

Certain embodiments, for example, for the production of triglycerides or wax esters, may comprise mutations such as point mutations, insertions, or full or partial deletions of one or more endogenous aldehyde decarbonylase genes. One example of an aldehyde decarbonylase is encoded by orf1593 in *S. elongatus* PCC7942. Another example is an aldehyde decarbonylase encoded by orfsll0208 in *Synechocystis* sp. PCC6803.

Thioesterases (TES).

In certain embodiments, a modified photosynthetic microorganism comprises one or more polynucleotides encoding one or more thioesterases (TES) including acyl-ACP thioesterases and/or acyl-CoA thioesterases. In certain embodiments, the polynucleotide sequence of the TES encodes a TesA or TesB polypeptide from *E. coli*, or a cytoplasmic TesA variant (*TesA) having the sequence set forth in SEQ ID NO:121.

In certain embodiments, the polynucleotide sequence of the TES comprises that of the FatB gene, encoding a FatB enzyme, such as a C8, C12, C14, C16, or C18 FatB enzyme. In certain embodiments, the polynucleotide encodes a thioesterase (e.g., FatB thioesterase), having only thioesterase activity and little or no lysophospholipase activity. In certain embodiments, the thioesterase is a FatB acyl-ACP thioesterase, which can hydrolyze acyl-ACP but not acyl-CoA. SEQ ID NO:197 is an exemplary nucleotide sequence of a C8/C10 FatB2 thioesterase derived from *Cuphea hookeriana*, and SEQ ID NO:122 is codon-optimized for expression in Cyanobacteria. SEQ ID NO:123 is an exemplary nucleotide sequence of a C12 FatB1 acyl-ACP thioesterase derived from *Umbellularia californica*, and SEQ ID NO:124 is a codon-optimized version of SEQ ID NO:123 for optimal expression in Cyanobacteria. SEQ ID NO:126 is an exemplary nucleotide sequence of a C14 FatB1 thioesterase derived from *Cinnamomum camphora*, and SEQ:125 is a codon-optimized version of SEQ ID NO:126. SEQ ID NO:127 is an exemplary nucleotide sequence of a C16 FatB1 thioesterase derived from *Cuphea hookeriana*, and SEQ ID NO:128 is a codon-optimized version of SEQ ID NO:127. In certain embodiments, one or more FatB sequences are operably linked to a strong promoter, such as a Ptrc promoter. In other embodiments, one or more FatB sequences are operably linked to a relatively weak promoter, such as an arabinose promoter.

Acetyl Coenzyme A Carboxylases (ACCase).

In certain embodiments, a polynucleotide encodes an acetyl-CoA carboxylase (ACCase) comprising or consisting of a polypeptide sequence set forth in any of SEQ ID NOs:55, 45, 46, 47, 48 or 49, or a fragment or variant thereof. In particular embodiments, a ACCase polynucleotide comprises or consists of a polynucleotide sequence set forth in any of SEQ ID NOs:56, 57, 50, 51, 52, 53 or 54, or a fragment or variant thereof. SEQ ID NO:55 is the sequence of *Saccharomyces cerevisiae* acetyl-CoA carboxylase (yAcc1); and SEQ ID NO:56 is a codon-optimized for expression in Cyanobacteria sequence that encodes yAcc1. SEQ ID NO:45 is *Synechococcus* sp. PCC 7002 AccA; SEQ ID NO:46 is *Synechococcus* sp. PCC 7002 AccB; SEQ ID NO:47 is *Synechococcus* sp. PCC 7002 AccC; and SEQ ID NO:48 is *Synechococcus* sp. PCC 7002 AccD. SEQ ID NO:50 encodes *Synechococcus* sp. PCC 7002 AccA; SEQ ID NO:51 encodes *Synechococcus* sp. PCC 7002 AccB; SEQ ID NO:52 encodes *Synechococcus* sp. PCC 7002 AccC; and SEQ ID NO:53 encodes *Synechococcus* sp. PCC 7002 AccD. SEQ ID NO:49 is a *Triticum aestivum* ACCase; and SEQ ID NO:54 encodes this *Triticum aestivum* ACCase.

Phosphatidic Acid Phosphatases (PAP).

In certain embodiments, a polynucleotide encodes a phosphatidate phosphatase (also referred to as a phosphatidic acid phosphatase; PAP) comprising or consisting of a polypeptide sequence set forth in SEQ ID NO:131, or a fragment or variant thereof. In particular embodiments, a phosphatidate phosphatase polynucleotide comprises or consists of a polynucleotide sequence set forth in SEQ ID NO:129 or SEQ ID NO:130, or a fragment or variant thereof. SEQ ID NO:131 is the sequence of *Saccharomyces cerevisiae* phosphatidate phosphatase (yPAH1), and SEQ ID NO:129 is a codon-optimized for expression in Cyanobacteria sequence that encodes yPAH1. In certain embodiments, the nucleotide sequence of the PAP is derived from the *E. coli* PgpB gene, and/or the PAP gene from *Synechocystis* sp. PCC6803.

Triacylglycerol (TAG) Hydrolases.

Certain embodiments employ one or more TAG hydrolase encoding polynucleotide sequences. Non-limiting examples of TAG hydrolase polynucleotide sequences include SDP1 (SUGAR-DEPENDENT1) triacylglycerol lipase from *Arabidopsis thaliana* (SEQ ID NO:153), ACIAD1335 from *Acinetobacter* sp. ADP1 (SEQ ID NO:154), TG14P from *S. cerevisiae* (SEQ ID NO:175), and RHA1_ro04722 (YP_704665) TAG lipase from *Rhodococcus* (SEQ ID NO:155). Additional polynucleotide sequences for exemplary lipases/esterases include RHA1_ro01602 lipase/esterase from *Rhodococcus* sp. (see SEQ ID NO:156), and the RHA1_ro06856 lipase/esterase (see SEQ ID NO:119) from *Rhodococcus* sp.

Fatty Acyl-CoA Synthetases.

Certain embodiments employ one or more fatty acyl-CoA synthetase encoding polynucleotide sequences. One exemplary fatty acyl-CoA synthetase includes the FadD gene from *E. coli* (SEQ ID NO:16) which encodes a fatty acyl-CoA synthetase having substrate specificity for medium and long chain fatty acids. Other exemplary fatty acyl-CoA synthetases include those derived from *S. cerevisiae*; for example, the Faa1p coding sequence is set forth in SEQ ID NO:18, the Faa2p coding sequence is set forth in SEQ ID NO:20, and the Faa3p is set forth in SEQ ID NO:22. SEQ ID NO:22 is codon-optimized for expression in *S. elongatus* PCC7942.

Lipases/Phospholipases.

In certain embodiments, a modified photosynthetic microorganism comprises one or more polynucleotides encoding one or more lipases or phospholipases, including lysophospholipases, or a fragment or variant thereof. In certain embodiments, the encoded lysophospholipase is Lysophospholipase L1 (TesA), Lysophospholipase L2, TesB, Vu Patatin 1 protein, or a homolog thereof.

In particular embodiments, the encoded phospholipase, e.g., a lysophospholipase, is a bacterial phospholipase, or a fragment or variant thereof, and the polynucleotide comprises a bacterial phospholipase polynucleotide sequence, e.g., a sequence derived from *Escherichia coli*, *Enterococcus faecalis*, or *Lactobacillus plantarum*. In particular embodiments, the encoded phospholipase is Lysophospholipase L1 (TesA), Lysophospholipase L2, TesB, Vu Patatin 1 protein, or a functional fragment thereof.

In certain embodiments, a lysophospholipase is a bacterial Lysophospholipase L1 (TesA) or TesB, such as an *E. coli* Lysophospholipase L1 encoded by a polynucleotide (pldC) having the wild-type sequence set forth in SEQ ID NO:196, or an *E. coli* TesB encoded by a polynucleotide having the wild-type sequence set forth in SEQ ID NO:132. The polypeptide sequence of *E. coli* Lysophospholipase L1 is provided in SEQ ID NO:133, and the polypeptide sequence of *E. coli* TesB is provided in SEQ ID NO:134. In other embodiments, a lysophospholipase is a Lysophospholipase L2, such as an *E. coli* Lysophospholipase L2 encoded by a polynucleotide (pldB) having the wild-type sequence set forth in SEQ ID NO:135, or a Vu patatin 1 protein encoded by a polynucleotide having the wild-type sequence set forth in SEQ ID NO:136. The polypeptide sequence of *E. coli* Lysophospholipase L2 is provided in SEQ ID NO:137, and the polypeptide sequence of Vu patatin 1 protein is provided in SEQ ID NO:138.

In particular embodiments, the polynucleotide encoding the phospholipase variant is modified such that it encodes a phospholipase that localizes predominantly to the cytoplasm instead of the periplasm. For example, it may encode a phospholipase having a deletion or mutation in a region associated with periplasmic localization. In particular embodiments, the encoded phospholipase variant is derived from Lysophospholipase L1 (TesA). In certain embodiments, the Lysophospholipase L1 (TesA) variant is a bacterial TesA, such as an *E. coli* Lysophospholipase (TesA) variant encoded by a polynucleotide having the sequence set forth in SEQ ID NO:139. The polypeptide sequence of the Lysophospholipase L1 variant is provided in SEQ ID NO:121 (PldC(*TesA)).

Additional examples of phospholipase-encoding polynucleotide sequences include phospholipase A1 (PldA) from *Acinetobacter* sp. ADP1 (SEQ ID NO:140), phospholipase A (PldA) from *E. coli* (SEQ ID NO:141), phospholipase from *Streptomyces coelicolor* A3(2) (SEQ ID NO:142), phospholipase A2 (PLA2-α) from *Arabidopsis thaliana* (SEQ ID NO:143). phospholipase A1/triacylglycerol lipase (DAD1; Defective Anther Dehiscence 1) from *Arabidopsis thaliana* (SEQ ID NO:144), chloroplast DONGLE from *Arabidopsis thaliana* (SEQ ID NO:145), patatin-like protein from *Arabidopsis thaliana* (SEQ ID NO:146), and patatin from *Anabaena variabilis* ATCC 29413 (SEQ ID NO:147). Additional non-limiting examples of lysophospholipase-encoding polynucleotide sequences include phospholipase B (Plb1p) from *Saccharomyces cerevisiae* S288c (SEQ ID NO:148), phospholipase B (Plb2p) from *Saccharomyces cerevisiae* S288c (SEQ ID NO:149), ACIAD1057 (TesA homolog) from *Acinetobacter* ADP1 (SEQ ID NO:150), ACIAD1943 lysophospholipase from *Acinetobacter* ADP1 (SEQ ID NO:151), and a lysophospholipase (YP_702320; RHA1_ro02357) from *Rhodococcus* (SEQ ID NO:152).

(iii) Glycogen Biosynthesis, Storage, and Breakdown Genes

Glycogen Biosynthesis and Storage Genes.

As noted above, certain embodiments include reduced or eliminated expression and/or activity of one or more polypeptides associated with glycogen biosynthesis and/or storage, for instance, by mutation of one or more genes that encode such polypeptides. Included are full or partial deletions, and point mutations or insertions of one or more glycogen biosynthesis/storage genes that reduce or eliminate expression and/or biological activity of the encoded protein(s). Exemplary genes associated with glycogen synthesis and/or storage include glgC, pgm, and glgA.

Examples of such glgC polynucleotide sequences are provided in SEQ ID NOs:28 (*Synechocystis* sp. PCC6803), 34 (*Nostoc* sp. PCC 7120), 33 (*Anabaena variabilis*), 32 (*Trichodesmium erythraeum* IMS 101), 27 (*Synechococcus elongatus* PCC7942), 30 (*Synechococcus* sp. WH8102), 31 (*Synechococcus* sp. RCC 307), and 29 (*Synechococcus* sp. PCC 7002), which respectively encode GlgC polypeptides having sequences set forth in SEQ ID NOs: 86, 87, 88, 89, 90, 91, 92, and 93.

Examples of such pgm polynucleotide sequences are provided in SEQ ID NOs: 25 (*Synechocystis* sp. PCC6803), 75 (*Synechococcus elongatus* PCC7942), 26 (*Synechococcus* sp. WH8102), 78 (*Synechococcus* RCC307), and 80 (*Synechococcus* 7002), which respectively encode Pgm polypeptides having sequences set forth in SEQ ID NOs:74, 76, 77, 79 and 81.

Examples of such glgA polynucleotide sequences are provided in SEQ ID NOs:36 (*Synechocystis* sp. PCC6803), 42 (*Nostoc* sp. PCC 7120), 41 (*Anabaena variabilis*), 40 (*Trichodesmium erythraeum* IMS 101), 35 (*Synechococcus elongatus* PCC7942), 38 (*Synechococcus* sp. WH8102), 39 (*Synechococcus* sp. RCC 307), and 37 (*Synechococcus* sp. PCC 7002), which respectively encode GlgA polypeptides having sequences set forth in SEQ ID NOs:94, 95, 96, 97, 98, 99, 100 and 101.

Glycogen Breakdown Genes.

In certain embodiments, a modified photosynthetic microorganism comprise one or more polynucleotides encoding one or more polypeptides associated with a glycogen breakdown, or a fragment or variant thereof. In particular embodiments, the one or more polypeptides are glycogen phosphorylase (GlgP), glycogen isoamylase (GlgX), glucanotransferase (MalQ), phosphoglucomutase (Pgm), glucokinase (Glk), and/or phosphoglucose isomerase (Pgi), or a functional fragment or variant thereof.

A representative glgP polynucleotide sequence is provided in SEQ ID NO:67, and a representative GlgP polypeptide sequence is provided in SEQ ID NO:68. A representative glgX polynucleotide sequence is provided in SEQ ID NO:69, and a representative GlgX polypeptide sequence is provided in SEQ ID NO:70. A representative malQ polynucleotide sequence is provided in SEQ ID NO:71, and a representative MalQ polypeptide sequence is provided in SEQ ID NO:72. A representative phosphoglucomutase (pgm) polynucleotide sequence is provided in SEQ ID NO:24, and a representative phosphoglucomutase (Pgm) polypeptide sequence is provided in SEQ ID NO:73, with others provided infra (SEQ ID NOs:25, 26, 74-81). A representative glk polynucleotide sequence is provided in SEQ ID NO:82, and a representative Glk polypeptide sequence is provided in SEQ ID NO:83. A representative pgi polynucleotide sequence is provided in SEQ ID NO:84, and a representative Pgi polypeptide sequence is provided in SEQ ID NO:85.

(iv) Polynucleotide Variants, Fragments, Vectors, and Expression Systems

In particular embodiments, a polynucleotide comprises one of these polynucleotide sequences, or a fragment or variant thereof, or encodes one of these polypeptide sequences, or a fragment or variant thereof.

Exemplary nucleotide sequences that encode the proteins and enzymes of the application encompass full-length reference polynucleotides, as well as portions of the full-length or substantially full-length nucleotide sequences of these genes or their transcripts or DNA copies of these transcripts. Portions of a nucleotide sequence may encode polypeptide portions or segments that retain the biological activity of the reference polypeptide. A portion of a nucleotide sequence that encodes a biologically active fragment of an enzyme provided herein may encode at least about 20, 21, 22, 23, 24, 25, 30, 40, 50, 60, 70, 80, 90, 100, 120, 150, 200, 300, 400, 500, 600, or more contiguous amino acid residues, almost up to the total number of amino acids present in a full-length enzyme. It will be readily understood that "intermediate lengths," in this context and in all other contexts used herein, means any length between the quoted values, such as 101, 102, 103, etc.; 151, 152, 153, etc.; 201, 202, 203, etc.

The polynucleotides described herein, regardless of the length of the coding sequence itself, may be combined with other DNA sequences, such as promoters, polyadenylation signals, additional restriction enzyme sites, multiple cloning sites, other coding segments, and the like, such that their overall length may vary considerably. It is therefore contemplated that a polynucleotide fragment of almost any length may be employed, with the total length preferably being limited by the ease of preparation and use in the intended recombinant DNA protocol.

The disclosure also contemplates variants of the reference polynucleotide sequences described herein (see, e.g., the Sequence Listing). Nucleic acid variants can be naturally-occurring, such as allelic variants (same locus), homologs (different locus), and orthologs (different organism) or can be non naturally-occurring. Naturally occurring variants such as these can be identified and isolated using well-known molecular biology techniques including, for example, various polymerase chain reaction (PCR) and hybridization-based techniques as known in the art. Naturally occurring variants can be isolated from any organism that encodes one or more genes having an activity of a reference polypeptide. Embodiments of the present invention, therefore, encompass Cyanobacteria comprising such naturally-occurring polynucleotide variants.

Non-naturally occurring variants can be made by mutagenesis techniques, including those applied to polynucleotides, cells, or organisms. The variants can contain nucleotide substitutions, deletions, inversions and insertions. Variation can occur in either or both the coding and non-coding regions. In certain aspects, non-naturally occurring variants may have been optimized for use in Cyanobacteria, such as by engineering and screening the enzymes for increased activity, stability, or any other desirable feature.

The variations can produce both conservative and non-conservative amino acid substitutions (as compared to the originally encoded product). For nucleotide sequences, conservative variants include those sequences that, because of the degeneracy of the genetic code, encode the amino acid sequence of a reference polypeptide. Variant nucleotide sequences also include synthetically derived polynucleotide sequences, such as those generated, for example, by using site-directed mutagenesis but which still encode a biologically active reference polypeptide, as described elsewhere herein. Generally, variants of a particular polynucleotide sequence will have at least about 30%, 40% 50%, 55%, 60%, 65%, 70%, generally at least about 75%, 80%, 85%, 90%, 95% or 98% or more sequence identity to a reference polynucleotide sequence as determined by sequence alignment programs described elsewhere herein using default parameters.

Known reference polynucleotide sequences (e.g., described herein) can be used to isolate corresponding sequences and alleles from other organisms, particularly other microorganisms. Methods are readily available in the art for the hybridization of nucleic acid sequences. Coding sequences from other organisms may be isolated according to well known techniques based on their sequence identity with the coding sequences set forth herein. In these techniques all or part of the known coding sequence is used as a probe which selectively hybridizes to other reference coding sequences present in a population of cloned genomic DNA fragments or cDNA fragments (i.e., genomic or cDNA libraries) from a chosen organism.

Accordingly, the present disclosure also contemplates polynucleotides that hybridize to reference nucleotide sequences, or to their complements, under stringency conditions described below. As used herein, the term "hybridizes under low stringency, medium stringency, high stringency, or very high stringency conditions" describes conditions for hybridization and washing. Guidance for performing hybridization reactions can be found in Ausubel et al., (1998, supra), Sections 6.3.1-6.3.6. Aqueous and non-aqueous methods are described in that reference and either can be used.

Reference herein to "low stringency" conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions).

"Medium stringency" conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C.

"High stringency" conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5 M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C.

In certain embodiments, a reference polypeptide or enzyme described herein is encoded by a polynucleotide that hybridizes to a disclosed nucleotide sequence under very high stringency conditions. One embodiment of very high stringency conditions includes hybridizing in 0.5 M sodium phosphate, 7% SDS at 65° C., followed by one or more washes in 0.2×SSC, 1% SDS at 65° C.

Other stringency conditions are well known in the art and the skilled artisan will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

While stringent washes are typically carried out at temperatures from about 42° C. to 68° C., one skilled in the art will appreciate that other temperatures may be suitable for stringent conditions. Maximum hybridization rate typically occurs at about 20° C. to 25° C. below the $T_m$ for formation of a DNA-DNA hybrid. It is well known in the art that the $T_m$ is the melting temperature, or temperature at which two complementary polynucleotide sequences dissociate. Methods for estimating $T_m$ are well known in the art (see Ausubel et al., supra at page 2.10.8).

In general, the $T_m$ of a perfectly matched duplex of DNA may be predicted as an approximation by the formula: $T_m = 81.5 + 16.6 \, (\log_{10} M) + 0.41 \, (\% \, G+C) - 0.63 \, (\% \, \text{formamide}) - (600/\text{length})$ wherein: M is the concentration of Na$^+$, preferably in the range of 0.01 molar to 0.4 molar; % G+C is the sum of guanosine and cytosine bases as a percentage of the total number of bases, within the range between 30% and 75% G+C; % formamide is the percent formamide concentration by volume; length is the number of base pairs in the DNA duplex. The $T_m$ of a duplex DNA decreases by approximately 1° C. with every increase of 1% in the number of randomly mismatched base pairs. Washing is generally carried out at $T_m$–15° C. for high stringency, or $T_m$–30° C. for moderate stringency.

In one example of a hybridization procedure, a membrane (e.g., a nitrocellulose membrane or a nylon membrane) containing immobilized DNA is hybridized overnight at 42° C. in a hybridization buffer (50% deionized formamide, 5×SSC, 5× Reinhardt's solution (0.1% fecal, 0.1% polyvinylpyrollidone and 0.1% bovine serum albumin), 0.1% SDS and 200 mg/mL denatured salmon sperm DNA) containing a labeled probe. The membrane is then subjected to two sequential medium stringency washes (i.e., 2×SSC, 0.1% SDS for 15 min at 45° C., followed by 2×SSC, 0.1% SDS for 15 min at 50° C.), followed by two sequential higher stringency washes (i.e., 0.2×SSC, 0.1% SDS for 12 min at 55° C. followed by 0.2×SSC and 0.1% SDS solution for 12 min at 65-68° C.).

Polynucleotides and fusions thereof may be prepared, manipulated and/or expressed using any of a variety of well established techniques known and available in the art. For example, polynucleotide sequences which encode polypeptides of the invention, or fusion proteins or functional equivalents thereof, may be used in recombinant DNA molecules to direct expression of a triglyceride or lipid biosynthesis enzyme in appropriate host cells. Due to the inherent degeneracy of the genetic code, other DNA sequences that encode substantially the same or a functionally equivalent amino acid sequence may be produced and these sequences may be used to clone and express a given polypeptide.

As will be understood by those of skill in the art, it may be advantageous in some instances to produce polypeptide-encoding nucleotide sequences possessing non-naturally occurring codons. For example, codons preferred by a particular prokaryotic or eukaryotic host can be selected to increase the rate of protein expression or to produce a recombinant RNA transcript having desirable properties, such as a half-life which is longer than that of a transcript generated from the naturally occurring sequence. Such nucleotides are typically referred to as "codon-optimized."

Moreover, the polynucleotide sequences described herein can be engineered using methods generally known in the art in order to alter polypeptide encoding sequences for a variety of reasons, including but not limited to, alterations which modify the cloning, processing, expression and/or activity of the gene product.

In order to express a desired polypeptide, a nucleotide sequence encoding the polypeptide, or a functional equivalent, may be inserted into appropriate expression vector, i.e., a vector that contains the necessary elements for the transcription and translation of the inserted coding sequence. Methods which are well known to those skilled in the art may be used to construct expression vectors containing sequences encoding a polypeptide of interest and appropriate transcriptional and translational control elements. These methods include in vitro recombinant DNA techniques, synthetic techniques, and in vivo genetic recombination. Such techniques are described in Sambrook et al., Molecular Cloning, A Laboratory Manual (1989), and Ausubel et al., Current Protocols in Molecular Biology (1989).

A variety of expression vector/host systems are known and may be utilized to contain and express polynucleotide sequences. In certain embodiments, the polynucleotides of the present disclosure may be introduced and expressed in Cyanobacterial systems. As such, the present disclosure contemplates the use of vector and plasmid systems having regulatory sequences (e.g., promoters and enhancers) that are suitable for use in various Cyanobacteria (see, e.g., Koksharova et al., *Applied Microbiol Biotechnol* 58:123-37, 2002). For example, the promiscuous RSF1010 plasmid provides autonomous replication in several Cyanobacteria of the genera *Synechocystis* and *Synechococcus* (see, e.g., Mermet-Bouvier et al., *Curr Microbiol* 26:323-327, 1993). As another example, the pFC1 expression vector is based on the promiscuous plasmid RSF1010. pFC1 harbors the lambda cl857 repressor-encoding gene and pR promoter, followed by the lambda cro ribosome-binding site and ATG translation initiation codon (see, e.g., Mermet-Bouvier et al., *Curr Microbiol* 28:145-148, 1994). The latter is located within the unique NdeI restriction site (CATATG) of pFC1 and can be exposed after cleavage with this enzyme for in-frame fusion with the protein-coding sequence to be expressed.

The "control elements" or "regulatory sequences" present in an expression vector (or employed separately) are those non-translated regions of the vector—enhancers, promoters, 5' and 3' untranslated regions—which interact with host cellular proteins to carry out transcription and translation. Such elements may vary in their strength and specificity. Depending on the vector system and host utilized, any number of suitable transcription and translation elements, including constitutive and inducible promoters, may be used. Generally, it is well-known that strong *E. coli* promoters work well in Cyanobacteria. Also, when cloning in Cyanobacterial systems, inducible promoters such as the hybrid lacZ promoter of the PBLUESCRIPT phagemid (Stratagene, La Jolla, Calif.) or PSPORT1 plasmid (Gibco BRL, Gaithersburg, Md.) and the like may be used. Other vectors containing IPTG inducible promoters, such as pAM1579 and pAM2991trc, may be utilized according to the present invention.

Certain embodiments may employ a temperature inducible system or temperature inducible regulatory sequences (e.g., promoters, enhancers, repressors). As one example, an operon with the bacterial phage left-ward promoter ($P_L$) and a temperature sensitive repressor gene C1857 may be employed to produce a temperature inducible system for producing fatty acids and/or triglycerides in Cyanobacteria (see, e.g., U.S. Pat. No. 6,306,639, herein incorporated by reference). It is believed that at a non-permissible temperature (low temperature, 30 degrees Celsius), the repressor binds to the operator sequence, and thus prevents RNA polymerase from initiating transcription at the $P_L$ promoter. Therefore, the expression of encoded gene or genes is repressed. When the cell culture is transferred to a permissible temperature (37-42 degrees Celsius), the repressor cannot bind to the operator. Under these conditions, RNA polymerase can initiate the transcription of the encoded gene or genes.

In Cyanobacterial systems, a number of expression vectors or regulatory sequences may be selected depending upon the use intended for the expressed polypeptide. When large quantities are needed, vectors or regulatory sequences which direct high level expression of encoded proteins may be used. For example, overexpression of ACCase enzymes may be utilized to increase fatty acid biosynthesis. Such vectors include, but are not limited to, the multifunctional *E. coli* cloning and expression vectors such as BLUESCRIPT (Stratagene), in which the sequence encoding the polypeptide of interest may be ligated into the vector in frame with sequences for the amino-terminal Met and the subsequent 7 residues of β-galactosidase so that a hybrid protein is produced; pIN vectors (Van Heeke & Schuster, *J. Biol. Chem.* 264:5503 5509 (1989)); and the like. pGEX Vectors (Promega, Madison, Wis.) may also be used to express foreign polypeptides as fusion proteins with glutathione S-transferase (GST).

Certain embodiments may employ Cyanobacterial promoters or regulatory operons. In certain embodiments, a promoter may comprise an rbcLS operon of *Synechococcus*, as described, for example, in Ronen-Tarazi et al. (*Plant Physiology* 18:1461-1469, 1995), or a cpc operon of *Synechocystis* sp. strain PCC 6714, as described, for example, in Imashimizu et al. (*J Bacteriol.* 185:6477-80, 2003). In certain embodiments, the tRNApro gene from *Synechococcus* may also be utilized as a promoter, as described in Chungjatupornchai et al. (*Curr Microbiol.* 38:210-216, 1999). Certain embodiments may employ the nirA promoter from *Synechococcus* sp. strain PCC7942, which is repressed by ammonium and induced by nitrite (see, e.g., Maeda et al., *J. Bacteriol.* 180:4080-4088, 1998; and Qi et al., *Applied and Environmental Microbiology* 71:5678-5684, 2005). The efficiency of expression may be increased by the inclusion of enhancers which are appropriate for the particular Cyanobacterial cell system which is used, such as those described in the literature.

In certain embodiments, expression vectors or introduced promoters utilized to overexpress an exogenous or endogenous reference polypeptide, or fragment or variant thereof, comprise a weak promoter under non-inducible conditions, e.g., to avoid toxic effects of long-term overexpression of any of these polypeptides. One example of such a vector for use in Cyanobacteria is the pBAD vector system. Expression levels from any given promoter may be determined, e.g., by performing quantitative polymerase chain reaction (qPCR) to determine the amount of transcript or mRNA produced by a promoter, e.g., before and after induction. In certain instances, a weak promoter is defined as a promoter that has a basal level of expression of a gene or transcript of interest, in the absence of inducer, that is ≤2.0% of the expression level produced by the promoter of the rnpB gene in *S. elongatus* PCC7942. In other embodiments, a weak promoter is defined as a promoter that has a basal level of expression of a gene or transcript of interest, in the absence of inducer, that is ≤5.0% of the expression level produced by the promoter of the rnpB gene in *S. elongatus* PCC7942.

It will be apparent that further to their use in vectors, any of the regulatory elements described herein (e.g., promoters, enhancers, repressors, ribosome binding sites, transcription termination sites) may be introduced directly into the genome of a photosynthetic microorganism (e.g., Cyanobacterium), typically in a region surrounding (e.g., upstream or downstream of) an endogenous or naturally-occurring reference gene/polynucleotide sequence described herein, to regulate expression (e.g., facilitate overexpression) of that gene.

Specific initiation signals may also be used to achieve more efficient translation of sequences encoding a polypeptide of interest. Such signals include the ATG initiation codon and adjacent sequences. In cases where sequences encoding the polypeptide, its initiation codon, and upstream sequences are inserted into the appropriate expression vector, no additional transcriptional or translational control signals may be needed. However, in cases where only coding sequence, or a portion thereof, is inserted, exogenous translational control signals including the ATG initiation codon should be provided. Furthermore, the initiation codon should be in the correct reading frame to ensure translation of the entire insert. Exogenous translational elements and initiation codons may be of various origins, both natural and synthetic.

A variety of protocols for detecting and measuring the expression of polynucleotide-encoded products, using either polyclonal or monoclonal antibodies specific for the product are known in the art. Examples include enzyme-linked immunosorbent assay (ELISA), radioimmunoassay (RIA), and fluorescence activated cell sorting (FACS). These and other assays are described, among other places, in Hampton et al., *Serological Methods*, a Laboratory Manual (1990) and Maddox et al., *J. Exp. Med.* 158:1211-1216 (1983). The presence or expression levels of a desired polynucleotide may also be confirmed by PCR.

A wide variety of labels and conjugation techniques are known by those skilled in the art and may be used in various nucleic acid and amino acid assays. Means for producing labeled hybridization or PCR probes for detecting sequences related to polynucleotides include oligolabeling, nick translation, end-labeling or PCR amplification using a labeled nucleotide. Alternatively, the sequences, or any portions thereof may be cloned into a vector for the production of an mRNA probe. Such vectors are known in the art, are commercially available, and may be used to synthesize RNA probes in vitro by addition of an appropriate RNA polymerase such as T7, T3, or SP6 and labeled nucleotides. These procedures may be conducted using a variety of commercially available kits. Suitable reporter molecules or labels, which may be used include radionuclides, enzymes, fluorescent, chemiluminescent, or chromogenic agents as well as substrates, cofactors, inhibitors, magnetic particles, and the like.

Cyanobacterial host cells transformed with a polynucleotide sequence of interest may be cultured under conditions suitable for the expression and recovery of the protein from cell culture. The protein produced by a recombinant cell may be secreted or contained intracellularly depending on the sequence and/or the vector used. As will be understood by those of skill in the art, expression vectors containing polynucleotides of the disclosure may be designed to contain signal sequences which direct localization of the encoded polypeptide to a desired site within the cell. Other recombinant constructions may be used to join sequences encoding a polypeptide of interest to nucleotide sequence encoding a polypeptide domain which will direct secretion of the encoded protein.

Modified Photosynthetic Microorganisms

Certain embodiments relate to modified photosynthetic microorganisms, including Cyanobacteria, and methods of use thereof, wherein the modified photosynthetic microorganisms comprise one or more over-expressed, exogenous or introduced intracellular localization domain-DGAT fusion proteins, and a corresponding polynucleotide that encodes the same, where the DGAT fusion protein comprises a heterologous intracellular localization domain and a DGAT polypeptide, or variant or fragment thereof. In particular embodiments, the DGAT fusion protein is a membrane-targeting domain- or plasma membrane (PM)-targeting domain-DGAT fusion proteins. In some embodiments, the DGAT polypeptide variant or fragment retains at least 50% of one or more activities of the wild-type DGAT polypeptide.

In certain aspects, the DGAT-fusion protein-expressing photosynthetic microorganisms described herein can further comprise one or more introduced or overexpressed lipid biosynthesis proteins. Examples of lipid biosynthesis proteins include, without limitation, acyl carrier proteins (ACP), acyl ACP synthases (Aas), acyl-ACP reductases, alcohol dehydrogenases, aldehyde dehydrogenases, aldehyde decarbonylases, thioesterases (TES), acetyl coenzyme A carboxylases (ACCase), phosphatidic acid phosphatases (PAP; or phosphatidate phosphatases), triacylglycerol (TAG) hydrolases, fatty acyl-CoA synthetases, and lipases/phospholipases, including any combinations thereof.

Certain preferred combinations include modified photosynthetic microorganisms having an exogenous or overexpressed DGAT fusion protein described herein in combination with an exogenous or overexpressed ACP; a DGAT fusion protein in combination with an Aas; a DGAT fusion protein in combination with an ACP and an Aas; a DGAT fusion protein in combination with an ACP and a TES such as *TesA or a FatB; a DGAT fusion protein in combination with an Aas and a TES such as *TesA or a FatB; and/or a DGAT fusion protein in combination with an ACP, an Aas, and a TES.

Also included are combinations that incorporate one or more TAG hydrolases into a TAG-producing strain. For example, certain embodiments include modified photosynthetic microorganisms having a DGAT fusion protein described herein, an exogenous or overexpressed ACP, Aas, or both, in combination with an exogenous or over-expressed TAG hydrolase, and optionally a TES. Certain embodiments, however, may employ a DGAT fusion protein and an over-expressed or exogenous TAG hydrolase, and optionally a TES, such as TesA (or *TesA) or any one or more of the FatB sequences, with or without an ACP or Aas. Hence, these and related embodiments may be employed separately from those that require an ACP, an Aas, or both. For instance, certain embodiments may comprise a DGAT fusion protein and TAG hydrolase, and optionally a TES. Any one of these embodiments can be further combined with one or more additional lipid biosynthesis proteins, such as an ACCase, a PAP, a fatty acyl-CoA synthetase, and/or a PL such as PLC.

Certain combinations incorporate one or more fatty acyl-CoA synthetases (e.g., FadD) into a DGAT fusion protein-expressing photosynthetic microorganism. For instance, certain embodiments include modified photosynthetic microorganisms having an exogenous or overexpressed ACP, Aas, or both, in combination with a DGAT fusion protein and a fatty acyl-CoA synthetase, and optionally a TES and/or a TAG hydrolase. Certain embodiments, however, may employ a DGAT fusion protein and an overexpressed or exogenous fatty acyl-CoA synthetase, and optionally a TES, such as TesA (or *TesA) or any one or more of the FatB sequences, with or without an ACP or Aas. Hence, these and related embodiments may be employed separately from those that require an ACP, Aas, or both. For instance, certain embodiments may comprise a DGAT fusion protein and a fatty acyl-CoA synthetase, and optionally a TES (e.g., TesA, FatB). Any one of these embodiments can be further combined with one or more additional lipid biosynthesis proteins, such as an ACCase, a PAP, a TAG hydrolase, and/or a PL such as PLC.

Any one of these embodiments can also be combined with one or more introduced or overexpressed polynucleotides encoding a protein involved in a glycogen breakdown pathway, and/or with a strain having reduced expression of glycogen biosynthesis or storage pathways (e.g., full or partial deletion of glucose-1-phosphate adenylyltransferase (glgC) gene and/or a phosphoglucomutase (pgm) gene). For instance, a specific modified photosynthetic microorganism could comprise a DGAT fusion protein described herein, an exogenous or overexpressed ACP, Aas, DGAT and PAP, combined with a full or partial deletion of the glgC gene and/or the pgm gene.

Photosynthetic microorganisms of the present disclosure can also be modified to increase the production of fatty acids by introducing one or more exogenous polynucleotide sequences that encode one or more enzymes associated with fatty acid synthesis. In certain aspects, the exogenous polynucleotide sequence encodes an enzyme that comprises an acetyl-CoA carboxylase (ACCase) activity, typically allowing increased ACCase expression, and, thus, increased intracellular ACCase activity. Increased intracellular ACCase activity contributes to the increased production of fatty acids because this enzyme catalyzes the "commitment step" of fatty acid synthesis. Similarly, in some aspects, modified photosynthetic microorganisms may comprise a DGAT fusion protein described herein in combination with an acyl-ACP reductase, for instance, to increase the production of fatty acids, a starting material for triglycerides, and thereby increase production of triglycerides.

Other combinations include, for example, a modified photosynthetic microorganism comprising a DGAT fusion protein described herein and one of the following: an exogenous or overexpressed ACP in combination with an exogenous or overexpressed ACCase; an Aas in combination with an ACCase; an ACP and an Aas in combination with an ACCase; an ACP in combination with a PAP; an Aas in combination with a PAP; an ACP and an Aas in combination with a PAP; an ACP in combination with a PL such as PLA, PLB, or PLC; an Aas in combination with a PL; and an ACP and an Aas in combination with a PL. Any one of these embodiments can be combined with each other (e.g., ACP, Aas, ACCase, and PAP), and/or further combined with an exogenous or overexpressed TES. Any one of these embodiments can also be combined with one or more introduced polynucleotides encoding a protein involved in a glycogen breakdown pathway, and/or with a strain having reduced expression of glycogen biosynthesis or storage pathways (e.g., full or partial deletion of glucose-1-phosphate adenylyltransferase (glgC) gene and/or a phosphoglucomutase (pgm) gene).

Any one of the above embodiments can also be combined with a strain having reduced expression of an aldehyde decarbonylase. In certain embodiments, such as Cyanobacteria including *S. elongatus* PCC7942, orf1593 resides directly upstream of orf1594 (acyl-ACP reductase coding region) and encodes an aldehyde decarbonylase. According to one non-limiting theory, because the aldehyde decarbonylase encoded by orf1593 utilizes acyl aldehyde as a substrate for alkane production, reducing expression of this protein may further increase yields of free fatty acids by shunting acyl aldehydes (produced by acyl-ACP reductase) away from an alkane-producing pathway, and towards a fatty acid-producing and storage pathway. PCC7942_orf1593 orthologs can be found, for example, in *Synechocystis* sp. PCC6803 (encoded by orfsll0208), *N. punctiforme* PCC 73102, *Thermosynechococcus elongatus* BP-1, *Synechococcus* sp. Ja-3-3AB, *P. marinus* MIT9313, *P. marinus* NATL2A, and *Synechococcus* sp. RS 9117, the latter having at least two paralogs (RS 9117-1 and -2). Included are strains having mutations or full or partial deletions of one or more genes encoding these and other aldehyde decarbonylases, such as *S. elongatus* PCC7942 having a full or partial deletion of orf1593, and *Synechocystis* sp. PCC6803 having a full or partial deletion of orfsll0208. For instance, a specific modified photosynthetic microorganism could comprise an overexpressed acyl-ACP reductase, combined with a full or partial deletion of the glgC gene and/or the pgm gene, optionally combined with an overexpressed ACP, ACCase, DGAT/acyl-CoA synthetase, or all of the foregoing, and optionally combined with a full or partial deletion of a gene encoding an aldehyde decarbonylase (e.g., PCC7942_orf1593, PCC6803_orfsll0208).

Any one of these embodiments can also be combined with a strain having reduced expression of an acyl-ACP synthetase (Aas). Without wishing to be bound by any one theory, an endogenous aldehyde dehydrogenase is acting on the acyl-aldehydes generated by orf1594 and converting them to free fatty acids. The normal role of such a dehydrogenase might involve removing or otherwise dealing with damaged lipids. In this scenario, it is then likely that the Aas gene product recycles these free fatty acids by ligating them to ACP. Accordingly, reducing or eliminating expression of the Aas gene product might ultimately increase production of fatty acids, by reducing or preventing their transfer to ACP. Included are mutations and full or partial deletions of one or more Aas genes, such as the Aas gene of *Synechococcus elongatus* PCC 7942. As one example, a specific modified photosynthetic microorganism could comprise an overexpressed acyl-ACP reductase, combined with a full or partial deletion of the glgC gene and/or the pgm gene, optionally combined with an overexpressed ACP, ACCase, DGAT/acyl-CoA synthetase, or all of the foregoing, optionally combined with a full or partial deletion of a gene encoding an aldehyde decarbonylase (e.g., PCC7942_orf1593, PCC6803_orfsll0208), and optionally combined with a full or partial deletion of an Aas gene encoding an acyl-ACP synthetase.

Any one or more of these embodiments can also be combined with a strain having increased expression of an aldehyde dehydrogenase. One exemplary aldehyde dehydrogenase is encoded by orf0489 of *Synechococcus elongatus* PCC7942. Also included are homologs or paralogs thereof, functional equivalents thereof, and fragments or variants thereof. Functional equivalents can include aldehyde dehydrogenases with the ability to convert acyl aldehydes (e.g., nonyl-aldehyde) into fatty acids. In specific embodiments, the aldehyde dehydrogenase has the amino acid sequence of SEQ ID NO:103 (encoded by the polynucleotide sequence of SEQ ID NO:102), or an active fragment or variant of this sequence.

Some modified photosynthetic microorganisms may comprise a DGAT fusion protein described herein and an introduced or overexpressed acyl-ACP reductase, to increase production of triglycerides; optionally in further combination with an introduced or overexpressed alcohol dehydrogenase, for instance, to produce wax esters relative to other lipids. Certain of these and related embodiments may be combined with reduced expression and/or activity of at least one endogenous aldehyde decarbonylase, endogenous aldehyde dehydrogenase, or both.

For instance, particular modified photosynthetic microorganisms may comprise a DGAT fusion protein described herein in combination with an overexpressed or introduced acyl-ACP reductase and an overexpressed or introduced alcohol dehydrogenase, and in further combination with at least one mutation (e.g., point mutation, insertion, full or partial deletion) that reduces the expression and/or activity of an endogenous aldehyde decarbonylase. Certain modified photosynthetic microorganisms may comprise a DGAT fusion protein in combination with an overexpressed or introduced acyl-ACP reductase and an overexpressed or introduced alcohol dehydrogenase, and in further combination with at least one mutation (e.g., point mutation, insertion, full or partial deletion) that reduces the expression and/or activity of an endogenous aldehyde dehydrogenase. Some embodiments may include modified photosynthetic microorganisms that comprises a DGAT fusion protein in combination with an overexpressed or introduced acyl-ACP reductase and an overexpressed or introduced alcohol dehydrogenase, in further combination with at least one mutation that reduces the expression and/or activity of an endogenous aldehyde dehydrogenase and at least one mutation that reduces the expression and/or activity of an endogenous aldehyde decarbonylase. In specific embodiments, for instance, where the modified photosynthetic microorganism is *S. elongatus*, the aldehyde dehydrogenase is encoded by orf0489 and the aldehyde decarbonylase is encoded by orf1593 of *S. elongatus*.

Other combinations include, for example, a modified photosynthetic microorganism comprising a DGAT fusion protein described herein and reduced glycogen accumulation, in combination with one more of an overexpressed ACP; an overexpressed acyl-ACP reductase in combination with an overexpressed ACP; an overexpressed acyl-ACP reductase in combination with an overexpressed ACCase; an overexpressed acyl-ACP reductase in combination with an overexpressed ACP and an overexpressed ACCase; an overexpressed acyl-ACP reductase in combination with an overexpressed acyl-CoA synthetase (e.g., a membrane-targeting domain-DGAT fusion/acyl-CoA synthetase combination); an overexpressed acyl-ACP reductase with an overexpressed ACCase optionally in combination with an overexpressed acyl-CoA synthetase; and an overexpressed acyl-ACP reductase with an overexpressed ACP and ACCase, optionally in combination with an overexpressed acyl-CoA synthetase. Acyl-ACP reductase and DGAT-overexpressing strains, optionally in combination with an overexpressed acyl-CoA synthetase, typically produce increased triglycerides relative to DGAT-only overexpressing strains. Any one of these embodiments can be combined with one or more introduced polynucleotides encoding a protein involved in a glycogen breakdown pathway, and/or with a strain having reduced expression of glycogen biosynthesis or storage pathways (e.g., full or partial deletion of glucose-1-phosphate adenylyltransferase (glgC) gene and/or a phosphoglucomutase (pgm) gene). The present disclosure contemplates the use of any type of polynucleotide encoding a protein or enzyme associated with glycogen breakdown, removal, and/or elimination, as long as the modified photosynthetic microorganism accumulates a reduced amount of glycogen as compared to the wild type photosynthetic microorganism.

Increased expression or overexpression can be achieved a variety of ways, for example, by introducing a polynucleotide into the microorganism, modifying an endogenous gene to overexpress the polypeptide (e.g., by introducing an exogenous regulatory element such as a promoter), or both. For instance, one or more copies of an otherwise endogenous polynucleotide sequence can be introduced by recombinant techniques to increase expression, that is, to create additional copies of the otherwise endogenous polynucleotide sequence. Decreased expression and/or activity can also be achieved a variety of ways, described elsewhere herein and known in the art, including by mutation of coding and/or regulatory sequences of a gene of interest, and/or by RNA inhibition.

Modified photosynthetic microorganisms of the present disclosure may be produced using any type of photosynthetic microorganism. These include, but are not limited to photosynthetic bacteria, green algae, and cyanobacteria. The photosynthetic microorganism can be, for example, a naturally photosynthetic microorganism, such as a Cyanobacterium, or an engineered photosynthetic microorganism, such as an artificially photosynthetic bacterium. Exemplary microorganisms that are either naturally photosynthetic or can be engineered to be photosynthetic include, but are not limited to, bacteria; fungi; archaea; protists; eukaryotes, such as a green algae; and animals such as plankton, planarian, and amoeba. Examples of naturally occurring photosynthetic microorganisms include, but are not limited to, *Spirulina maximum, Spirulina platensis, Dunaliella salina, Botrycoccus braunii, Chlorella vulgaris, Chlorella pyrenoidosa, Serenastrum capricomutum, Scenedesmus auadricauda, Porphyridium cruentum, Scenedesmus acutus, Dunaliella* sp.*, Scenedesmus obliquus, Anabaenopsis, Aulosira, Cylindrospermum, Synechococcus* sp.*, Synechocystis* sp., and/or *Tolypothrix*.

A modified Cyanobacteria of the present disclosure may be from any genera or species of Cyanobacteria that is genetically manipulable, i.e., permissible to the introduction and expression of exogenous genetic material. Examples of Cyanobacteria that can be engineered according to the methods of the present disclosure include, but are not limited to, the genus *Synechocystis, Synechococcus, Thermosynechococcus, Nostoc, Prochlorococcu, Microcystis, Anabaena, Spirulina*, and *Gloeobacter*.

Cyanobacteria, also known as blue-green algae, blue-green bacteria, or Cyanophyta, is a phylum of bacteria that obtain their energy through photosynthesis. Cyanobacteria can produce metabolites, such as carbohydrates, proteins, lipids and nucleic acids, from $CO_2$, water, inorganic salts and light. Any Cyanobacteria may be used according to the present invention.

Cyanobacteria include both unicellular and colonial species. Colonies may form filaments, sheets or even hollow balls. Some filamentous colonies show the ability to differentiate into several different cell types, such as vegetative cells, the normal, photosynthetic cells that are formed under favorable growing conditions; akinetes, the climate-resistant spores that may form when environmental conditions become harsh; and thick-walled heterocysts, which contain the enzyme nitrogenase, vital for nitrogen fixation.

Heterocysts may also form under the appropriate environmental conditions (e.g., anoxic) whenever nitrogen is necessary. Heterocyst-forming species are specialized for nitrogen fixation and are able to fix nitrogen gas, which cannot be used by plants, into ammonia ($NH_3$), nitrites ($NO_2^-$), or nitrates ($NO_3^-$), which can be absorbed by plants and converted to protein and nucleic acids.

Many Cyanobacteria also form motile filaments, called hormogonia, which travel away from the main biomass to bud and form new colonies elsewhere. The cells in a hormogonium are often thinner than in the vegetative state, and the cells on either end of the motile chain may be tapered. In order to break away from the parent colony, a hormogonium often must tear apart a weaker cell in a filament, called a necridium.

Each individual Cyanobacterial cell typically has a thick, gelatinous cell wall. Cyanobacteria differ from other gram-negative bacteria in that the quorum sensing molecules autoinducer-2 and acyl-homoserine lactones are absent. They lack flagella, but hormogonia and some unicellular species may move about by gliding along surfaces. In water columns, some Cyanobacteria float by forming gas vesicles, like in archaea.

Cyanobacteria have an elaborate and highly organized system of internal membranes that function in photosynthesis. Photosynthesis in Cyanobacteria generally uses water as an electron donor and produces oxygen as a by-product, though some Cyanobacteria may also use hydrogen sulfide, similar to other photosynthetic bacteria. Carbon dioxide is reduced to form carbohydrates via the Calvin cycle. In most forms, the photosynthetic machinery is embedded into folds of the cell membrane, called thylakoids. Due to their ability to fix nitrogen in aerobic conditions, Cyanobacteria are often found as symbionts with a number of other groups of organisms such as fungi (e.g., lichens), corals, pteridophytes (e.g., *Azolla*), and angiosperms (e.g., *Gunnera*), among others.

Cyanobacteria are the only group of organisms that are able to reduce nitrogen and carbon in aerobic conditions. The water-oxidizing photosynthesis is accomplished by coupling the activity of photosystem (PS) II and I (Z-scheme). In anaerobic conditions, Cyanobacteria are also able to use only PS I (i.e., cyclic photophosphorylation) with electron donors other than water (e.g., hydrogen sulfide, thiosulphate, or molecular hydrogen), similar to purple photosynthetic bacteria. Furthermore, Cyanobacteria share an archaeal property; the ability to reduce elemental sulfur by anaerobic respiration in the dark. The Cyanobacterial photosynthetic electron transport system shares the same compartment as the components of respiratory electron transport. Typically, the plasma membrane contains only components of the respiratory chain, while the thylakoid membrane hosts both respiratory and photosynthetic electron transport.

Phycobilisomes, attached to the thylakoid membrane, act as light harvesting proteins for the photosystems of Cyanobacteria. The phycobilisome components (phycobiliproteins) are responsible for the blue-green pigmentation of most Cyanobacteria. Color variations are mainly due to carotenoids and phycoerythrins, which may provide the cells with a red-brownish coloration. In some Cyanobacteria, the color of light influences the composition of phycobilisomes. In green light, the cells accumulate more phycoerythrin, whereas in red light they produce more phycocyanin. Thus, the bacteria appear green in red light and red in green light. This process is known as complementary chromatic adaptation and represents a way for the cells to maximize the use of available light for photosynthesis.

In particular embodiments, the Cyanobacteria may be, e.g., a marine form of Cyanobacteria or a freshwater form of Cyanobacteria. Examples of marine forms of Cyanobacteria include, but are not limited to *Synechococcus* WH8102*, Synechococcus* RCC307*, Synechococcus* NKBG 15041c, and *Trichodesmium*. Examples of freshwater forms of Cyanobacteria include, but are not limited to, *S. elongatus* PCC 7942, *Synechocystis* PCC 6803*, Plectonema boryanum*, and *Anabaena* sp. Exogenous genetic material encoding the desired enzymes or polypeptides may be introduced either transiently, such as in certain self-replicating vectors, or stably, such as by integration (e.g., recombination) into the Cyanobacterium's native genome.

In other embodiments, a genetically modified Cyanobacteria of the present disclosure may be capable of growing in brackish or salt water. When using a freshwater form of Cyanobacteria, the overall net cost for production of triglycerides will depend on both the nutrients required to grow the culture and the price for freshwater. One can foresee freshwater being a limited resource in the future, and in that case it would be more cost effective to find an alternative to freshwater. Two such alternatives include: (1) the use of waste water from treatment plants; and (2) the use of salt or brackish water.

Salt water in the oceans can range in salinity between 3.1% and 3.8%, the average being 3.5%, and this is mostly, but not entirely, made up of sodium chloride (NaCl) ions. Brackish water, on the other hand, has more salinity than freshwater, but not as much as seawater. Brackish water contains between about 0.5% and 3% salinity, and thus includes a large range of salinity regimes and is therefore not precisely defined. Waste water is any water that has undergone human influence. It consists of liquid waste released from domestic and commercial properties, industry, and/or agriculture and can encompass a wide range of possible contaminants at varying concentrations.

There is a broad distribution of Cyanobacteria in the oceans, with *Synechococcus* filling just one niche. Specifically, *Synechococcus* sp. PCC 7002 (formerly known as *Agmenellum quadruplicatum* strain PR-6) grows in brackish water, is unicellular and has an optimal growing temperature of 38° C. While this strain is well suited to grow in conditions of high salt, it will grow slowly in freshwater. In particular embodiments, the present disclosure contemplates the use of a Cyanobacteria *S. elongatus* PCC 7942, altered in a way that allows for growth in either waste water or salt/brackish water. A *S. elongatus* PCC 7942 mutant resistant to sodium chloride stress has been described (Bagchi, S. N. et al., *Photosynth Res.* 2007, 92:87-101), and a genetically modified *S. elongatus* PCC 7942 tolerant of growth in salt water has been described (Waditee, R. et al., *PNAS.* 2002, 99:4109-4114). According to the present invention, a salt water tolerant strain is capable of growing in water or media having a salinity in the range of 0.5% to 4.0% salinity, although it is not necessarily capable of growing in all salinities encompassed by this range. In one embodiment, a salt tolerant strain is capable of growth in water or media having a salinity in the range of 1.0% to 2.0% salinity. In another embodiment, a salt water tolerant strain is capable of growth in water or media having a salinity in the range of 2.0% to 3.0% salinity.

Examples of Cyanobacteria that may be utilized and/or genetically modified according to the methods described herein include, but are not limited to, Chroococcales Cyanobacteria from the genera *Aphanocapsa, Aphanothece, Chamaesiphon, Chroococcus, Chroogloeocystis, Coelosphaerium, Crocosphaera, Cyanobacterium, Cyanobium, Cyanodictyon, Cyanosarcina, Cyanothece, Dactylococcopsis, Gloeocapsa, Gloeothece, Merismopedia, Microcystis, Radiocystis, Rhabdoderma, Snowella, Synychococcus, Synechocystis, Thermosenechococcus*, and *Woronichinia;* Nostacales Cyanobacteria from the genera *Anabaena, Anabaenopsis, Aphanizomenon, Aulosira, Calothrix, Coleodesmium, Cyanospira, Cylindrospermosis, Cylindrospermum, Fremyella, Gleotrichia, Microchaete, Nodularia, Nostoc, Rexia, Richelia, Scytonema, Sprirestis,* and *Toypothrix;* Oscillatoriales Cyanobacteria from the genera *Arthrospira, Geitlerinema, Halomicronema, Halospirulina, Katagnymene, Leptolyngbya, Limnothrix, Lyngbya, Microcoleus, Oscillatoria, Phormidium, Planktothricoides, Planktothrix, Plectonema, Pseudoanabaena/Limnothrix, Schizothrix, Spirulina, Symploca, Trichodesmium, Tychonema;* Pleurocapsales cyanobacterium from the genera *Chroococcidiopsis, Dermocarpa, Dermocarpella, Myxosarcina, Pleurocapsa, Stanieria, Xenococcus;* Prochlorophytes Cyanobacterium from the genera *Prochloron, Prochlorococcus, Prochlorothrix;* and Stigonematales cyanobacterium from the genera *Capsosira, Chlorogeoepsis, Fischerella, Hapalosiphon, Mastigocladopsis, Nostochopsis, Stigonema, Symphyonema, Symphonemopsis, Umezakia,* and *Westiellopsis.* In certain embodiments, the Cyanobacterium is from the genus *Synechococcus*, including, but not limited to *Synechococcus bigranulatus, Synechococcus elongatus, Synechococcus leopoliensis, Synechococcus lividus, Synechococcus nidulans,* and *Synechococcus rubescens.*

In certain embodiments, the Cyanobacterium is *Anabaena* sp. strain PCC 7120, *Synechocystis* sp. strain PCC 6803, *Nostoc muscorum, Nostoc ellipsosporum,* or *Nostoc* sp. strain PCC 7120. In certain preferred embodiments, the Cyanobacterium is *S. elongatus* sp. strain PCC 7942.

Additional examples of Cyanobacteria that may be utilized in the methods provided herein include, but are not limited to, *Synechococcus* sp. strains WH7803, WH8102, WH8103 (typically genetically modified by conjugation), Baeocyte-forming *Chroococcidiopsis* spp. (typically modified by conjugation/electroporation), non-heterocyst-forming filamentous strains *Planktothrix* sp., *Plectonema boryanum* M101 (typically modified by electroporation), and Heterocyst-forming strains *Anabaena* sp. strains ATCC 29413 (typically modified by conjugation), *Tolypothrix* sp. strain PCC 7601 (typically modified by conjugation/electroporation) and *Nostoc punctiforme* strain ATCC 29133 (typically modified by conjugation/electroporation).

In certain preferred embodiments, the Cyanobacterium may be *S. elongatus* sp. strain PCC 7942 or *Synechococcus* sp. PCC 7002 (originally known as *Agmenellum quadruplicatum*).

In particular embodiments, the genetically modified, photosynthetic microorganism, e.g., Cyanobacteria, of the present disclosure may be used to produce triglycerides and/or other carbon-based products from just sunlight, water, air, and minimal nutrients, using routine culture techniques of any reasonably desired scale. In certain embodiments, the present disclosure contemplates using spontaneous mutants of photosynthetic microorganisms that demonstrate a growth advantage under a defined growth condition. Among other benefits, the ability to produce large amounts of triglycerides from minimal energy and nutrient input makes the modified photosynthetic microorganism, e.g., Cyanobacteria, of the present disclosure a readily manageable and efficient source of feedstock in the subsequent production of both biofuels, such as biodiesel, as well as specialty chemicals, such as glycerin.

Methods of Producing Modified Photosynthetic Microorganisms

Embodiments of the present disclosure also include methods of producing the modified photosynthetic microorganisms (e.g., Cyanobacterium) described herein.

In certain embodiments, the present disclosure comprises methods of modifying a photosynthetic microorganism to produce a modified photosynthetic microorganism that produces an increased amount of lipids, e.g., triglycerides, relative to a corresponding wild type photosynthetic microorganism or a differently modified photosynthetic microorganism (e.g., one that expresses DGAT but not a form that selectively localizes to an intracellular region such as a membrane, including the plasma membrane), comprising introducing into the microorganism one or more polynucleotides encoding a intracellular localization domain-DGAT fusion protein described herein, including active fragments or variants thereof.

Also included are methods of modifying a photosynthetic microorganism to produce a modified photosynthetic microorganism that has improved cell growth characteristics, relative to a corresponding, DGAT-expressing modified photosynthetic microorganism where the DGAT does not have a heterologous intracellular localization domain (e.g., a wild-type DGAT), comprising introducing into the microorganism one or more polynucleotides encoding a intracellular localization domain-DGAT fusion protein described herein, including active fragments or variants thereof.

The methods may further comprise a step of selecting for photosynthetic microorganisms in which the one or more desired polynucleotides were successfully introduced, where the polynucleotides were, e.g., present in a vector that expressed a selectable marker, such as an antibiotic resistance gene. As one example, selection and isolation may include the use of antibiotic resistant markers known in the art (e.g., kanamycin, spectinomycin, and streptomycin).

In certain aspects, such photosynthetic microorganisms can be further modified by increasing the expression of one or more lipid biosynthesis proteins, for instance, by introducing an exogenous copy of a polynucleotide that encodes a lipid biosynthesis protein, by increasing expression of an endogenous lipid biosynthesis protein, or both. In some aspects, such photosynthetic microorganisms can be further modified by increasing the expression of one or more proteins associated with glycogen breakdown, for instance, by introducing an exogenous copy of a polynucleotide that encodes a glycogen breakdown protein, by increasing expression of an endogenous glycogen breakdown protein, or both.

Thus, in certain embodiments, the present disclosure includes methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, and (2) introducing into the photosynthetic microorganism one or more operatively linked promoters (e.g., inducible or regulable promoters) into a region upstream of an endogenous lipid biosynthesis protein coding sequence, and/or introducing one or more polynucleotides encoding a lipid biosynthesis protein, or a fragment or variant thereof. Exemplary lipid biosynthesis proteins include any one or more of acyl carrier proteins (ACP), acyl ACP synthetases (Aas), acyl-ACP reductases, alcohol dehydrogenases, aldehyde dehydrogenases, aldehyde decarbonylases, thioesterases (TES), acetyl coenzyme A carboxylases (ACCase), phosphatidic acid phosphatases (PAP; or phosphatidate phosphatases), triacylglycerol (TAG) hydrolases, fatty acyl-CoA synthetases, and lipases/phospholipases, including any combination thereof.

Certain embodiments include methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, and (2) introducing into the photosynthetic microorganism one or more operatively linked promoters (e.g., inducible or regulable promoters) into a region upstream of an endogenous glycogen breakdown protein coding sequence, and/or introducing one or more polynucleotides encoding a glycogen breakdown protein, or a fragment or variant thereof. Exemplary glycogen breakdown proteins include any one or more of glycogen phosphorylase (GlgP), glycogen isoamylase (GlgX), glucanotransferase (MalQ), phosphoglucomutase (Pgm), glucokinase (Glk), and/or phosphoglucose isomerase (Pgi), including any combination thereof.

Particular embodiments include methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous lipid biosynthesis protein coding sequence, and/or introducing one or more polynucleotides encoding a lipid biosynthesis protein, or a fragment or variant thereof, and (3) introducing into the photosynthetic microorganism one or more operatively linked promoters (e.g., inducible or regulable promoters) into a region upstream of an endogenous glycogen breakdown protein coding sequence, and/or introducing one or more polynucleotides encoding a glycogen breakdown protein, or a fragment or variant thereof.

In particular embodiments, the lipid biosynthesis protein is an acyl carrier protein (ACP), an acyl-ACP synthetase (Aas), or both. For instance, certain embodiments include methods for producing a modified photosynthetic microorganism, e.g., a Cyanobacteria, comprising: (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous ACP coding sequence, and/or introducing one or more polynucleotides encoding an ACP, or a fragment or variant thereof. These and related methods can further comprise (3) introducing into the photosynthetic microorganism one or more operatively linked promoters (e.g., inducible or regulable promoters) into a region upstream of an endogenous TES, ACCase, TAG hydrolase, fatty acyl CoA synthetase, PAP, and/or phospholipase coding sequence, and/or introducing one or more polynucleotides encoding TES, ACCase, TAG hydrolase, fatty acyl CoA synthetase, PAP, and/or phospholipase, or a fragment or variant thereof.

Some embodiments include methods for producing a modified photosynthetic microorganism, e.g., a Cyanobacteria, comprising: (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous Aas coding sequence, and/or introducing one or more polynucleotides encoding an Aas polypeptide, or a fragment or variant thereof. These and related methods can further comprise (3) introducing into the photosynthetic microorganism one or more operatively linked promoters (e.g., inducible or regulable promoters) into a region upstream of an endogenous TES, ACCase, TAG hydrolase, fatty acyl CoA synthetase, PAP, and/or phospholipase coding sequence, and/or introducing one or more polynucleotides encoding TES, ACCase, TAG hydrolase, fatty acyl CoA synthetase, PAP, and/or phospholipase, or a fragment or variant thereof.

Certain embodiments include methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous ACP coding sequence, and/or introducing one or more polynucleotides encoding an ACP, or a fragment or variant thereof, and (3) introducing into the photosynthetic microorganism one or more operatively linked promoters (e.g., inducible or regulable promoters) into a region upstream of an endogenous Aas coding sequence, and/or introducing one or more polynucleotides encoding an Aas polypeptide, or a fragment or variant thereof. These and related methods can further comprise (4) introducing into the photosynthetic microorganism one or more operatively linked promoters (e.g., inducible or regulable promoters) into a region upstream of an endogenous TES, ACCase, TAG hydrolase, fatty acyl CoA synthetase, PAP, and/or phospholipase coding sequence, and/or introducing one or more polynucleotides encoding TES, ACCase, TAG hydrolase, fatty acyl CoA synthetase, PAP, and/or phospholipase, or a fragment or variant thereof.

In some embodiments, the lipid biosynthesis protein is an acyl-ACP reductase, optionally in combination with an overexpressed alcohol dehydrogenase, for instance, to increase production of triglycerides and/or produce wax esters. Certain embodiments thus include methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, and (2) introducing into the photosynthetic microorganism one or more operatively linked promoters (e.g., inducible or regulable promoters) into a region upstream of an endogenous acyl-ACP reductase coding sequence, and/or introducing one or more polynucleotides encoding an acyl-ACP reductase, or a fragment or variant thereof.

For wax ester production, also included are methods of producing a modified photosynthetic microorganism, e.g., a Cyanobacteria, comprising: (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous acyl-ACP reductase coding sequence, and/or introducing one or more polynucleotides encoding an acyl-ACP reductase, or a fragment or variant thereof, and (3) introducing into the photosynthetic microorganism one or more operatively linked promoters (e.g., inducible or regulable promoters) into a region upstream of an endogenous alcohol dehydrogenase coding sequence, and/or introducing one or more polynucleotides encoding an alcohol dehydrogenase, or a fragment or variant thereof.

Any of the photosynthetic microorganisms described herein can be further modified by reducing expression and/or activity of one or more endogenous genes/proteins associated with glycogen synthesis and/or storage, one or more endogenous aldehyde dehydrogenases, one or more endogenous aldehyde decarbonylases, and/or one or more endogenous Aas polypeptides. Exemplary genes/proteins associated with glycogen synthesis and/or storage include glgA, glgC, and pgm.

In particular embodiments, expression or activity is reduced by knocking out or knocking down one or more alleles of the one or more genes. In particular embodiments, expression or activity of the one or more genes is reduced by contacting the photosynthetic microorganism with an antisense oligonucleotide or interfering RNA, e.g., an siRNA, that targets the one or more genes. In certain embodiments, a vector that expresses a polynucleotide that hybridizes to the one or more genes, e.g., an antisense oligonucleotide or an siRNA is introduced into the photosynthetic microorganism. Also included is the generation of mutants, such as point mutants, insertions, or full or partial deletions of a gene of interest and/or one or more of its regulatory elements (e.g., promoters, enhancers), to reduce expression and/or activity of a protein of interest. Natural selection or directed selection can also be used to identify naturally-occurring mutants having reduced expression and/or activity of a protein of interest.

For instance, particular embodiments include methods for producing a modified photosynthetic microorganism having reduced expression and/or activity of an aldehyde dehydrogenase, an aldehyde decarbonylase, or both. These and related embodiments may comprise (1) introducing into the photosynthetic microorganism one or more polynucleotides encoding one or more intracellular localization domain-DGAT fusion proteins, and (2) introducing one or more mutations into an endogenous gene encoding an aldehyde dehydrogenase, such as a point mutation, insertion, or full or partial deletion, which reduces expression and/or activity of the aldehyde dehydrogenase, e.g., renders the aldehyde dehydrogenase "non-functional," as described herein. Also included are methods for producing a modified photosynthetic microorganism, comprising (1) introducing into the photosynthetic microorganism one or more polynucleotides encoding one or more intracellular localization domain-DGAT fusion proteins, and (2) introducing one or more mutations into an endogenous gene encoding an aldehyde decarbonylase, such as a point mutation, insertion, or full or partial deletion, which reduces expression and/or activity of the aldehyde decarbonylase.

Some embodiments include methods for producing a modified photosynthetic microorganism, comprising (1) introducing into the photosynthetic microorganism one or more polynucleotides encoding one or more intracellular localization domain-DGAT fusion proteins, (2) introducing one or more mutations into an endogenous gene encoding an aldehyde dehydrogenase, such as a point mutation, insertion, or full or partial deletion, which reduces expression and/or activity of the aldehyde dehydrogenase, and (3) introducing one or more mutations into an endogenous gene encoding an aldehyde decarbonylase, such as a point mutation, insertion, or full or partial deletion, which reduces expression and/or activity of the aldehyde decarbonylase.

Particular methods include producing a modified photosynthetic microorganism having increased expression of an acyl-ACP reductase and an alcohol dehydrogenase, in combination with reduced expression and/or activity of an aldehyde dehydrogenase, reduced expression and/or activity of an aldehyde decarbonylase, or both. These and related embodiments can be useful in the production of wax esters, as described herein. Some embodiments thus include methods for producing a modified photosynthetic microorganism, comprising (1) introducing into the photosynthetic microorganism one or more polynucleotides encoding one or more intracellular localization domain-DGAT fusion proteins, (2) introducing into the photosynthetic microorganism one or more operatively linked promoters (e.g., inducible or regulable promoters) into a region upstream of an endogenous acyl-ACP reductase coding sequence, and/or introducing one or more polynucleotides encoding an acyl-ACP reductase, or a fragment or variant thereof, (3) introducing into the photosynthetic microorganism one or more operatively linked promoters (e.g., inducible or regulable promoters) into a region upstream of an endogenous alcohol dehydrogenase coding sequence, and/or introducing one or more polynucleotides encoding an alcohol dehydrogenase, or a fragment or variant thereof, and either or both of (4) introducing one or more mutations into an endogenous gene encoding an aldehyde dehydrogenase, such as a point mutation, insertion, or full or partial deletion, which reduces expression and/or activity of the aldehyde dehydrogenase, and (5) introducing one or more mutations into an endogenous gene encoding an aldehyde decarbonylase, such as a point mutation, insertion, or full or partial deletion, which reduces expression and/or activity of the aldehyde decarbonylase. In certain embodiments, for instance, where the photosynthetic microorganism is *S. elongatus*, the aldehyde dehydrogenase is encoded by orf0489, and the aldehyde decarbonylase is encoded by orf1593.

Photosynthetic microorganisms, e.g., Cyanobacteria, may be genetically modified according to techniques known in the art, e.g., delete a portion or all of a gene or to introduce a polynucleotide that expresses a functional polypeptide. As noted above, in certain aspects, genetic manipulation in photosynthetic microorganisms, e.g., Cyanobacteria, can be performed by the introduction of non-replicating vectors which contain native photosynthetic microorganism sequences, exogenous genes of interest, and selectable markers or drug resistance genes. Upon introduction into the photosynthetic microorganism, the vectors may be integrated into the photosynthetic microorganism's genome through homologous recombination. In this way, an exogenous gene of interest and the drug resistance gene are stably integrated into the photosynthetic microorganism's genome. Such recombinants cells can then be isolated from non-recombinant cells by drug selection. Cell transformation methods and selectable markers for Cyanobacteria are also well known in the art (see, e.g., Wirth, *Mol Gen Genet* 216:175-7, 1989; and Koksharova, *Appl Microbiol Biotechnol* 58:123-37, 2002; and The Cyanobacteria: Molecular Biology, Genetics, and Evolution (eds. Antonio Herrera and Enrique Flores) Caister Academic Press, 2008, each of which is incorporated by reference for their description on gene transfer into Cyanobacteria, and other information on Cyanobacteria).

In certain embodiments, an endogenous version of a protein (e.g., ACP, Aas, TES, ACCase, TAG hydrolase, fatty acyl-CoA synthetase, PAP, PL), if present, can be overexpressed by introducing a heterologous or other promoter upstream of the endogenous gene encoding that protein, i.e., the naturally-occurring version of that gene.

Such promoters may be constitutive or inducible.

Generation of deletions or mutations of any of the one or more genes associated with the biosynthesis or storage of glycogen can be accomplished according to a variety of methods known in the art, including the use of a non-replicating, selectable vector system that is targeted to the upstream and downstream flanking regions of a given gene (e.g., glgC, pgm), and which recombines with the Cyanobacterial genome at those flanking regions to replace the endogenous coding sequence with the vector sequence. Given the presence of a selectable marker in the vector sequence, such as a drug selectable marker, Cyanobacterial cells containing the gene deletion can be readily isolated, identified and characterized. Such selectable vector-based recombination methods need not be limited to targeting upstream and downstream flanking regions, but may also be targeted to internal sequences within a given gene, as long as that gene is rendered "non-functional," as described herein.

The generation of deletions or mutations can also be accomplished using antisense-based technology. For instance, Cyanobacteria have been shown to contain natural regulatory events that rely on antisense regulation, such as a 177-nt ncRNA that is transcribed in antisense to the central portion of an iron-regulated transcript and blocks its accumulation through extensive base pairing (see, e.g., Dühring, et al., *Proc. Natl. Acad. Sci. USA* 103:7054-7058, 2006), as well as a alr1690 mRNA that overlaps with, and is complementary to, the complete furA gene, which acts as an antisense RNA (α-furA RNA) interfering with furA transcript translation (see, e.g., Hernandez et al., *Journal of Molecular Biology* 355:325-334, 2006). Thus, the incorporation of antisense molecules targeted to genes involved in glycogen biosynthesis or storage would be similarly expected to negatively regulate the expression of these genes, rendering them "non-functional," as described herein.

As used herein, antisense molecules encompass both single and double-stranded polynucleotides comprising a strand having a sequence that is complementary to a target coding strand of a gene or mRNA. Thus, antisense molecules include both single-stranded antisense oligonucleotides and double-stranded siRNA molecules.

Other modifications described herein may be produced using standard procedures and reagents, e.g., vectors, available in the art. Related methods are described in PCT Application No. WO 2010/075440, which is hereby incorporated by reference in its entirety.

Methods of Producing Lipids

The modified photosynthetic microorganisms and methods of the present disclosure may be used to produce lipids, such as fatty acids, triglycerides, and/or wax esters. Accordingly, the present disclosure provides methods of producing lipids, comprising culturing any of the modified photosynthetic microorganisms of the present disclosure (described elsewhere herein)

In one embodiment, the modified photosynthetic microorganism is a Cyanobacterium that produces or accumulates increased lipids relative to an unmodified or wild-type Cyanobacterium of the same species, or a differently modified Cyanobacterium of the same species. In certain embodiments, the modified photosynthetic microorganism is a Cyanobacterium that produces or accumulates increased triglycerides relative to an unmodified or wild-type Cyanobacterium of the same species, or a differently modified Cyanobacterium of the same species. In certain instances, the differently modified Cyanobacterium expresses a wild-type DGAT, and no other form(s) of DGAT. Other examples of differently modified Cyanobacteria are described herein. In certain aspects, increased triglyceride production is associated with improved cell growth characteristics relative to the differently modified Cyanobacterium, e.g., increased cell survival over time, and is thus measured over time, e.g., 2, 3, 4, 5, 6, 7, 8, 9, 10, 11, 12, 13, 14, or more days post-culture or post-induction of DGAT expression, or in a continuous culture system.

In one embodiment, the modified photosynthetic microorganism is a Cyanobacterium that produces or accumulates increased wax esters relative to an unmodified or wild-type Cyanobacterium of the same species, or a differently modified Cyanobacterium of the same species. In these and related embodiments, the Cyanobacterium overexpresses an acyl-ACP reductase and an alcohol dehydrogenase, in combination with an intracellular localization domain-DGAT fusion protein. In some embodiments, the differently modified Cyanobacterium is one that expresses DGAT in combination with an acyl-ACP reductase and an alcohol dehydrogenase, and thus produces wax esters, but expresses a wild-type DGAT and no other form of DGAT. In some aspects, increased wax ester production is associated with improved cell growth characteristics relative to the differently modified Cyanobacterium, e.g., increased cell survival over time, and is thus measured over time, e.g., 2, 3, 4, 5, 6, 7, 8, 9, 10, 11, 12, 13, 14, or more days post-culture or post-induction of DGAT expression, or in a continuous culture system.

In certain embodiments, the one or more introduced polynucleotides are present in one or more expression constructs. In particular embodiments, the one or more expression constructs comprises one or more inducible promoters. In certain embodiments, the one or more expression constructs are stably integrated into the genome of the modified photosynthetic microorganism.

In certain embodiments, the introduced polynucleotide encoding an introduced protein is present in an expression construct comprising a weak promoter under non-induced conditions. In certain embodiments, one or more of the introduced polynucleotides are codon-optimized for expression in a Cyanobacterium, e.g., a *Synechococcus elongatus*.

In particular embodiments, the photosynthetic microorganism is a *Synechococcus elongatus*, such as *Synechococcus elongatus* strain PCC7942 or a salt tolerant variant of *Synechococcus elongatus* strain PCC7942. In particular embodiments, the photosynthetic microorganism is a *Synechococcus* sp. PCC 7002 or a *Synechocystis* sp. PCC6803.

Photosynthetic microorganisms may be cultured according to techniques known in the art. For example, Cyanobacteria may be cultured or cultivated according to techniques known in the art, such as those described in Acreman et al. (*Journal of Industrial Microbiology and Biotechnology* 13:193-194, 1994), in addition to photobioreactor based techniques, such as those described in Nedbal et al. (*Biotechnol Bioeng.* 100:902-10, 2008). One example of typical laboratory culture conditions for Cyanobacterium is growth in BG-11 medium (ATCC Medium 616) at 30° C. in a vented culture flask with constant agitation and constant illumination at 30-100 μmole photons $m^{-2}$ $sec^{-1}$.

A wide variety of mediums are available for culturing Cyanobacteria, including, for example, Aiba and Ogawa (AO) Medium, Allen and Arnon Medium plus Nitrate (ATCC Medium 1142), Antia's (ANT) Medium, Aquil Medium, Ashbey's Nitrogen-free Agar, ASN-III Medium, ASP 2 Medium, ASW Medium (Artificial Seawater and derivatives), ATCC Medium 617 (BG-11 for Marine Blue-Green Algae; Modified ATCC Medium 616 [BG-11 medium]), ATCC Medium 819 (Blue-green Nitrogen-fixing Medium; ATCC Medium 616 [BG-11 medium] without $NO_3$), ATCC Medium 854 (ATCC Medium 616 [BG-11 medium] with Vitamin $B_{12}$), ATCC Medium 1047 (ATCC Medium 957 [MN marine medium] with Vitamin $B_{12}$), ATCC Medium 1077 (Nitrogen-fixing marine medium; ATCC Medium 957 [MN marine medium] without $NO_3$), ATCC Medium 1234 (BG-11 Uracil medium; ATCC Medium 616 [BG-11 medium] with uracil), *Beggiatoa* Medium (ATCC Medium 138), *Beggiatoa* Medium 2 (ATCC Medium 1193), BG-11 Medium for Blue Green Algae (ATCC Medium 616), Blue-Green (BG) Medium, Bold's Basal (BB) Medium, Castenholtz D Medium, Castenholtz D Medium Modified (Halophilic cyanobacteria), Castenholtz DG Medium, Castenholtz DGN Medium, Castenholtz ND Medium, *Chloroflexus* Broth, *Chloroflexus* Medium (ATCC Medium 920), Chu's #10 Medium (ATCC Medium 341), Chu's #10 Medium Modified, Chu's #11 Medium Modified, DCM Medium, DYIV Medium, E27 Medium, E31 Medium and Derivatives, f/2 Medium, f/2 Medium Derivatives, Fraquil Medium (Freshwater Trace Metal-Buffered Medium), Gorham's Medium for Algae (ATCC Medium 625), h/2 Medium, Jaworski's (JM) Medium, K Medium, L1 Medium and Derivatives, MN Marine Medium (ATCC Medium 957), Plymouth Erdschreiber (PE) Medium, *Prochlorococcus* PC Medium, Proteose Peptone (PP) Medium, Prov Medium, Prov Medium Derivatives, S77 plus Vitamins Medium, 588 plus Vitamins Medium, Saltwater Nutrient Agar (SNA) Medium and Derivatives, SES Medium, SN Medium, Modified SN Medium, SNAX Medium, Soil/Water Biphasic (S/W) Medium and Derivatives, SOT Medium for *Spirulina*: ATCC Medium 1679, *Spirulina* (SP) Medium, van Rijn and Cohen (RC) Medium, Walsby's Medium, Yopp Medium, and Z8 Medium, among others.

In particular embodiments, the modified photosynthetic microorganisms are cultured under conditions suitable for inducing expression of the introduced polynucleotide(s), e.g., wherein the introduced polynucleotide(s) comprise an inducible promoter. Conditions and reagents suitable for inducing inducible promoters are known and available in the art. Also included are the use of auto-inductive systems, for example, where a metabolite represses expression of the introduced polynucleotide, and the use of that metabolite by the microorganism over time decreases its concentration and thus its repressive activities, thereby allowing increased expression of the polynucleotide sequence.

In certain embodiments, modified photosynthetic microorganisms, e.g., Cyanobacteria, are grown under conditions favorable for producing lipids, triglycerides and/or fatty acids. In particular embodiments, light intensity is between 100 and 2000 uE/m2/s, or between 200 and 1000 uE/m2/s. In particular embodiments, the pH range of culture media is between 7.0 and 10.0. In certain embodiments, $CO_2$ is injected into the culture apparatus to a level in the range of 1% to 10%. In particular embodiments, the range of $CO_2$ is between 2.5% and 5%. In certain embodiments, nutrient supplementation is performed during the linear phase of growth. Each of these conditions may be desirable for triglyceride production.

In certain embodiments, the modified photosynthetic microorganisms are cultured, at least for some time, under static growth conditions as opposed to shaking conditions. For example, the modified photosynthetic microorganisms may be cultured under static conditions prior to inducing expression of an introduced polynucleotide (e.g., intracellular localization domain-DGAT fusion, acyl-ACP reductase, ACP, Aas, ACP/Aas, glycogen breakdown protein, ACCase, DGAT, fatty acyl-CoA synthetase, aldehyde dehydrogenase, alcohol dehydrogenase) and/or the modified photosynthetic microorganism may be cultured under static conditions while expression of an introduced polynucleotide is being induced, or during a portion of the time period during which expression of an introduced polynucleotide is being induced. Static growth conditions may be defined, for example, as growth without shaking or growth wherein the cells are shaken at less than or equal to 30 rpm or less than or equal to 50 rpm.

In certain embodiments, the modified photosynthetic microorganisms are cultured, at least for some time, in media supplemented with varying amounts of bicarbonate. For example, the modified photosynthetic microorganisms may be cultured with bicarbonate at 5, 10, 20, 50, 75, 100, 200, 300, 400, 500, 600, 700, 800, 900, 1000 mM bicarbonate prior to inducing expression of an introduced polynucleotide (e.g., membrane-targeting domain-DGAT fusion protein, acyl-ACP reductase, aldehyde dehydrogenase, ACP, Aas, ACP/Aas, glycogen breakdown protein, ACCase, DGAT, fatty acyl-CoA synthetase, alcohol dehydrogenase) and/or the modified photosynthetic microorganism may be cultured with aforementioned bicarbonate concentrations while expression of an introduced polynucleotide is being induced, or during a portion of the time period during which expression of an introduced polynucleotide is being induced.

In related embodiments, modified photosynthetic organisms and methods of the present disclosure may be used in the production of a biofuel and/or a specialty chemical, such as glycerin or a wax ester. Thus, in particular embodiments, a method of producing a biofuel comprises culturing any of the modified photosynthetic microorganisms of the present disclosure under conditions wherein the modified photosynthetic microorganism accumulates an increased amount of total cellular lipid, fatty acid, wax ester, and/or triglyceride, as compared to a corresponding wild-type photosynthetic microorganism, obtaining cellular lipid, fatty acid, wax ester, and/or triglyceride from the microorganism, and processing the obtained cellular lipid, fatty acid, wax ester, and/or triglyceride to produce a biofuel. In another embodiment, a method of producing a biofuel comprises processing lipids, fatty acids, wax esters, and/or triglycerides produced by a modified photosynthetic microorganism of the present disclosure to produce a biofuel. In a further embodiment, a method of producing a biofuel comprises obtaining lipid, fatty acid, wax esters, and/or triglyceride produced by a modified photosynthetic microorganism of the present invention, and processing the obtained cellular lipid, fatty acid, wax ester, and/or triglyceride to produce a biofuel. In particular embodiments, the modified photosynthetic organism is grown under conditions wherein it has reduced growth but maintains photosynthesis.

Methods of processing lipids from microorganisms to produce a biofuel or specialty chemical, e.g., biodiesel, are known and available in the art. For example, triglycerides may be transesterified to produce biodiesel. Transesterification may be carried out by any one of the methods known in the art, such as alkali-, acid-, or lipase-catalysis (see, e.g., Singh et al., *Recent Pat Biotechnol.* 2008, 2(2):130-143). Various methods of transesterification utilize, for example, use of a batch reactor, a supercritical alcohol, an ultrasonic reactor, or microwave irradiation (Such methods are described, e.g., in Jeong and Park, *Appl Biochem Biotechnol.* 2006, 131(1-3):668-679; Fukuda et al., *Journal of Bioscience and Engineering.* 2001, 92(5):405-416; Shah and Gupta, *Chemistry Central Journal.* 2008, 2(1):1-9; and Carrillo-Munoz et al., *J Org Chem.* 1996, 61(22):7746-7749). The biodiesel may be further processed or purified, e.g., by distillation, and/or a biodiesel stabilizer may be added to the biodiesel, as described in U.S. Patent Application Publication No. 2008/0282606.

Certain embodiments of the present disclosure now will be illustrated by the following Examples. The present disclosure may, however, be embodied in many different forms and should not be construed as limited to the embodiments set forth herein; rather, these embodiments are provided so that this disclosure will be thorough and complete, and will fully convey the scope of the disclosure to those skilled in the art.

EXAMPLES

Example 1

Figure 1B:
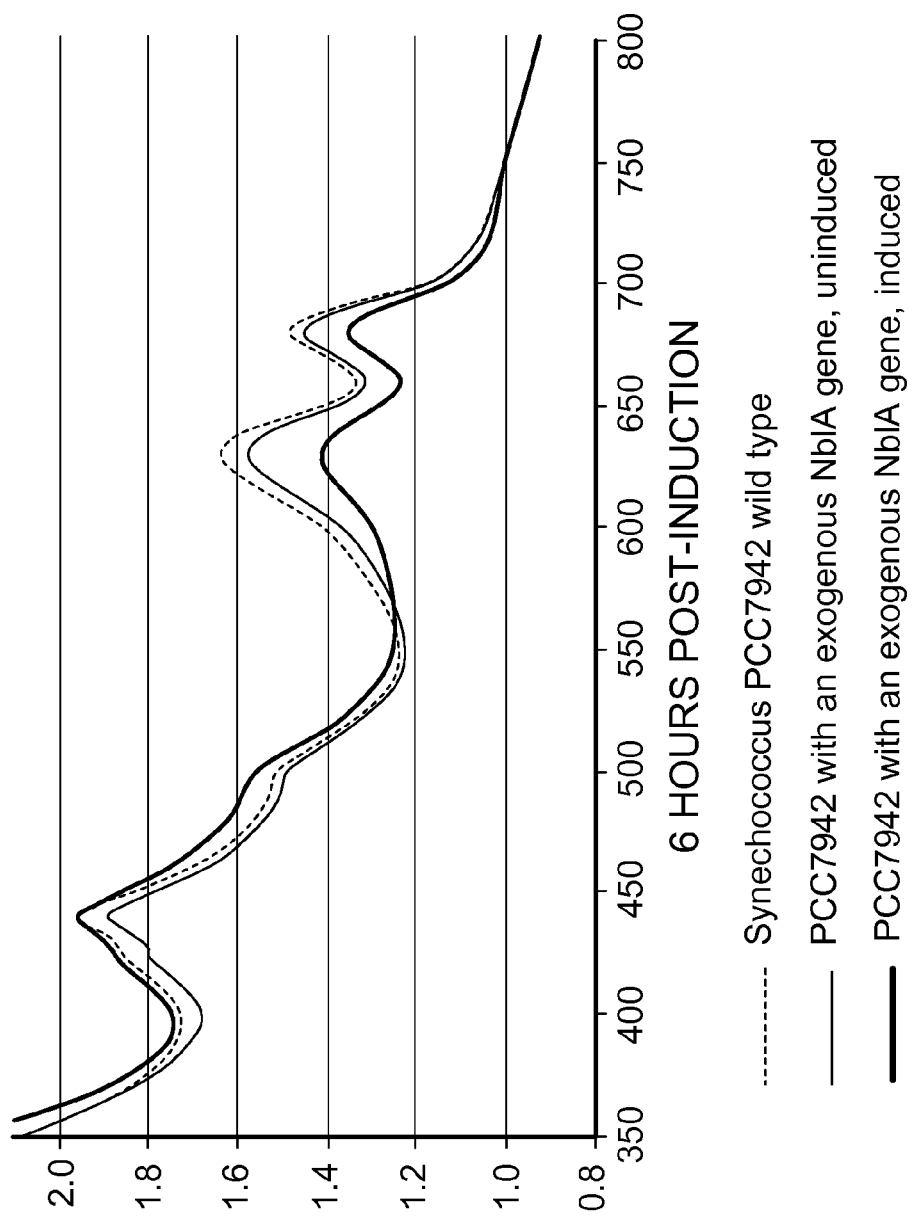

FIGS. 1A and 1B show a measurement of phycobilisomes, comparing wild-type to NblA overexpressor. *Synechococcus* PCC7942 wild type, PCC7942 with an exogenous NblA gene, uninduced or PCC7942 with an exogenous NblA gene, induced. Samples were collected at time zero (FIG. 1A) and at six hours (FIG. 1B) after induction of the NblA gene. Whole cells were examined by spectrophotometry, and absorbance as a function of wavelength was determined. The three major peaks represent absorption by chlorophyll A (at approximately 420 and 680 nm) and by phycobiliprotein (at approximately 630 nm). Induction of NblA caused a rapid decrease in light absorption by phycobiliprotein. Some reduction in the 680 nm chlorophyll A peak was also observed. These data show that phycobilisomes are reduced after modulated NblA expression, indicating that modulating NblA expression reduce phycobilisome abundance.

Example 2

Normalized photosynthetic activities of suspensions of wild type and modified cyanobacteria containing an arabinose-induced over-expression system of the gene nblA. Triplicate cultures of wild-type *Synechococcus* sp. PCC 7942, pBAD nblA uninduced and pBAD nblA induced (with 0.02% arabinose added) were harvested in log-phase (between $OD_{750}$ values of 0.4 and 0.6) and re-suspended in BG-11 medium with 20 mM Potassium Phosphate (pH 7.5) and 10 mM Sodium Bicarbonate additions. These suspensions were illuminated with Red+Blue LEDs in a calibrated Walz Dual Pam 100 Fluorometer (Walz, Germany) to total light intensities between 0 and 600 $pE*m^{-2}*s^{-1}$ and oxygen concentration was monitored by a NeoFox Oxygen Sensor (Ocean Optics, USA) continuously every second for 120 seconds at each light intensity. The slopes of the linear $O_2$ production rate was then found and plotted above for each culture time (n=3 for each type).

Figure 2:
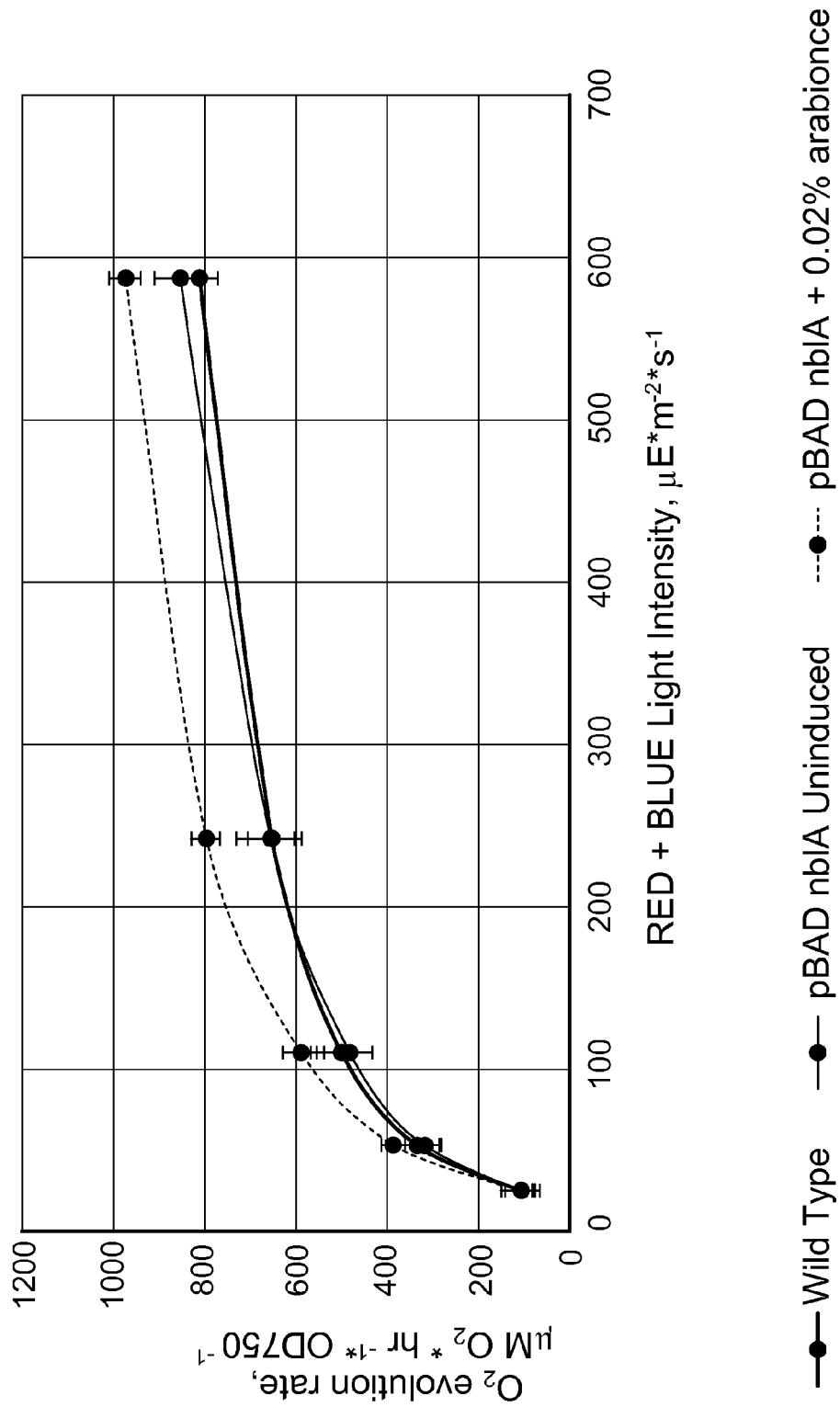
FIG. 2 shows normalized photosynthetic activities of suspensions of wild type and modified cyanobacteria containing an arabinose-induced over-expression system of the gene nblA. Triplicate cultures of wild-type *Synechococcus* sp. PCC 7942, pBAD nblA uninduced and pBAD nblA induced (with 0.02% arabinose added) were harvested in log-phase (between $OD_{750}$ values of 0.4 and 0.6) and re-suspended in BG-11 medium with 20 mM Potassium Phosphate (pH 7.5) and 10 mM Sodium Bicarbonate additions. These suspensions were illuminated with Red+Blue LEDs in a calibrated Walz Dual Pam 100 Fluorometer (Walz, Germany) to total light intensities between 0 and 600 $pE*m^{-2}*s^{-1}$ and oxygen concentration was monitored by a NeoFox Oxygen Sensor (Ocean Optics, USA) continuously every second for 120 seconds at each light intensity. The slopes of the linear $O_2$ production rate was then found and plotted above for each culture time (n=3 for each type).
Figure 3:
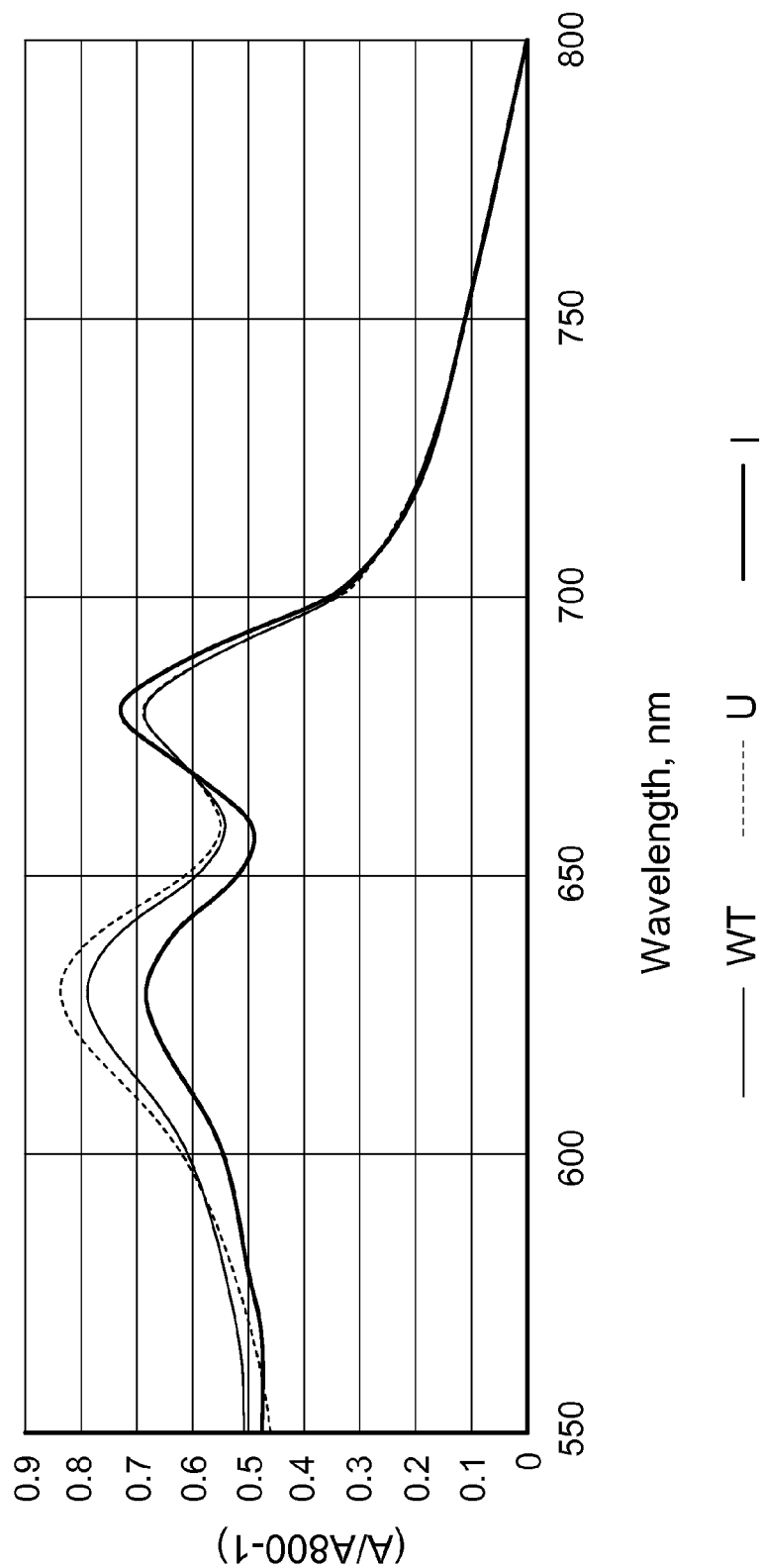
FIG. 3 shows representative normalized whole-cell absorbance spectra of wild type (WT), pBAD nblA uninduced (U), and pBAD nblA induced with 0.02% arabinose (I). Suspensions measured for FIG. 1 were diluted 1:2 in BG-11 and measured in a spectrophotometer. Absorbances were normalized by taking the absorbance value at each wavelength (A) and dividing by the absorbance value at 800 nm (A800) and subtracting 1 from that ratio.

As shown in FIG. 2, oxygen evolution rates of suspensions of cyanobacteria *Synechococcus* sp. PCC 7942 (herein denoted 57942) overexpressing nblA are higher than those of wild-type and an uninduced control strain (pBAD nblA uninduced) at incident light intensities between 100 and 600 $pE*m^{-2}*s^{-1}$. This is due to a decreased absorbance in whole cell spectra in the wavelength region of phycobilisomes as shown in FIG. 3. Whole cells were examined by spectrophotometry, and absorbance as a function of wavelength was determined. The decrease in absorbance by phycobiliprotein (at approximately 630 nm) as in FIG. 1 is shown. Induction of NblA caused a rapid decrease in light absorption by phycobiliprotein.

Example 3

Figure 4A:
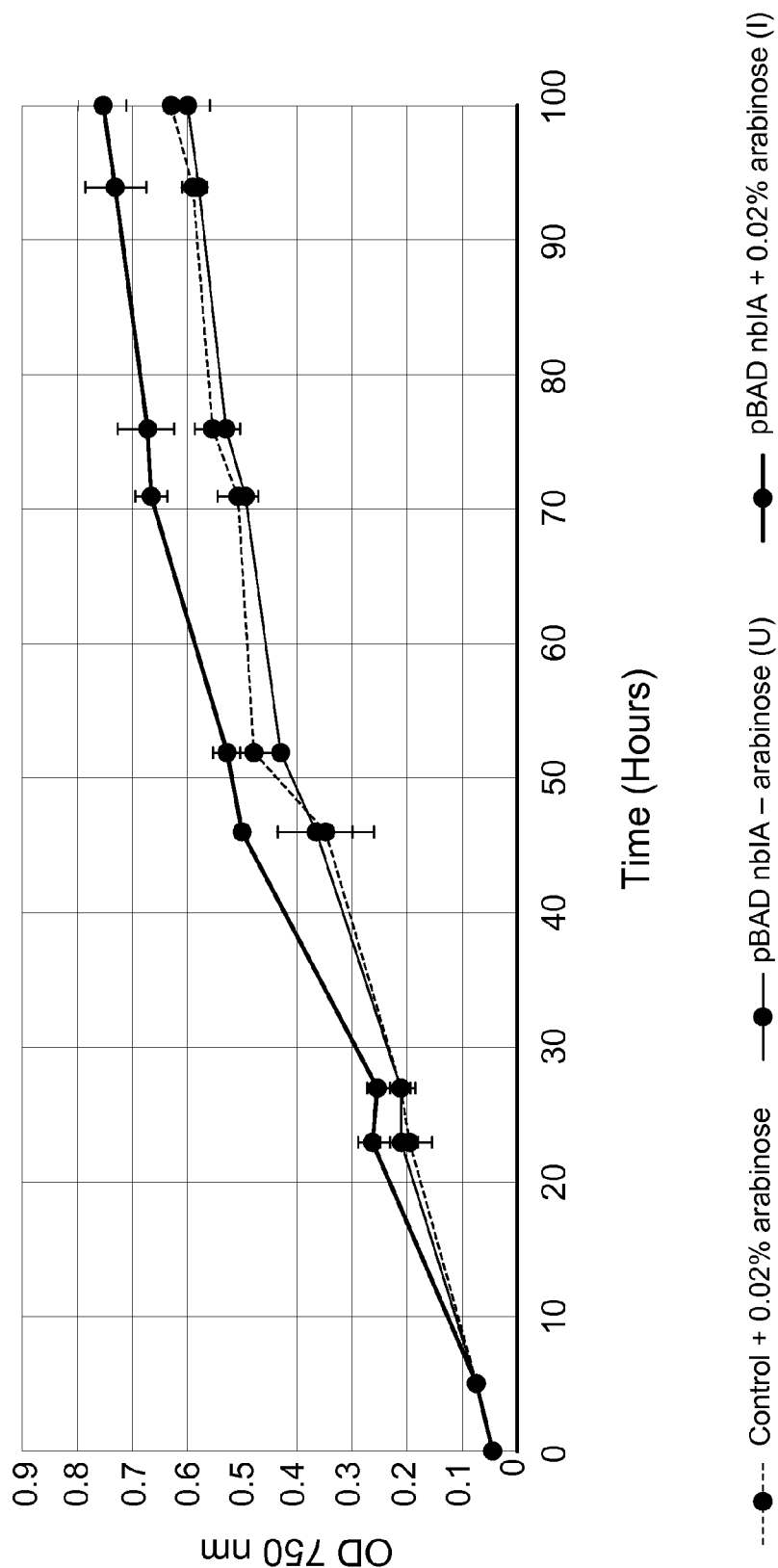
FIGS. 4A and 4B show growth of a control strain in the presence of 0.02% arabinose (which does not change optical characteristics in presence of arabinose), pBAD nblA, and pBAD nblA in the presence of 0.02% arabinose in photobioreactors as monitored by Optical Density (FIG. 4A) and dry weight (FIG. 4B). Optical density was measured by taking aliquots of culture and measuring absorbance at 750 nm. Dry weight was measured by weighing 0.2 micron pre-weight filters with dried cells from 5-10 mL culture aliquots.
Figure 4B:
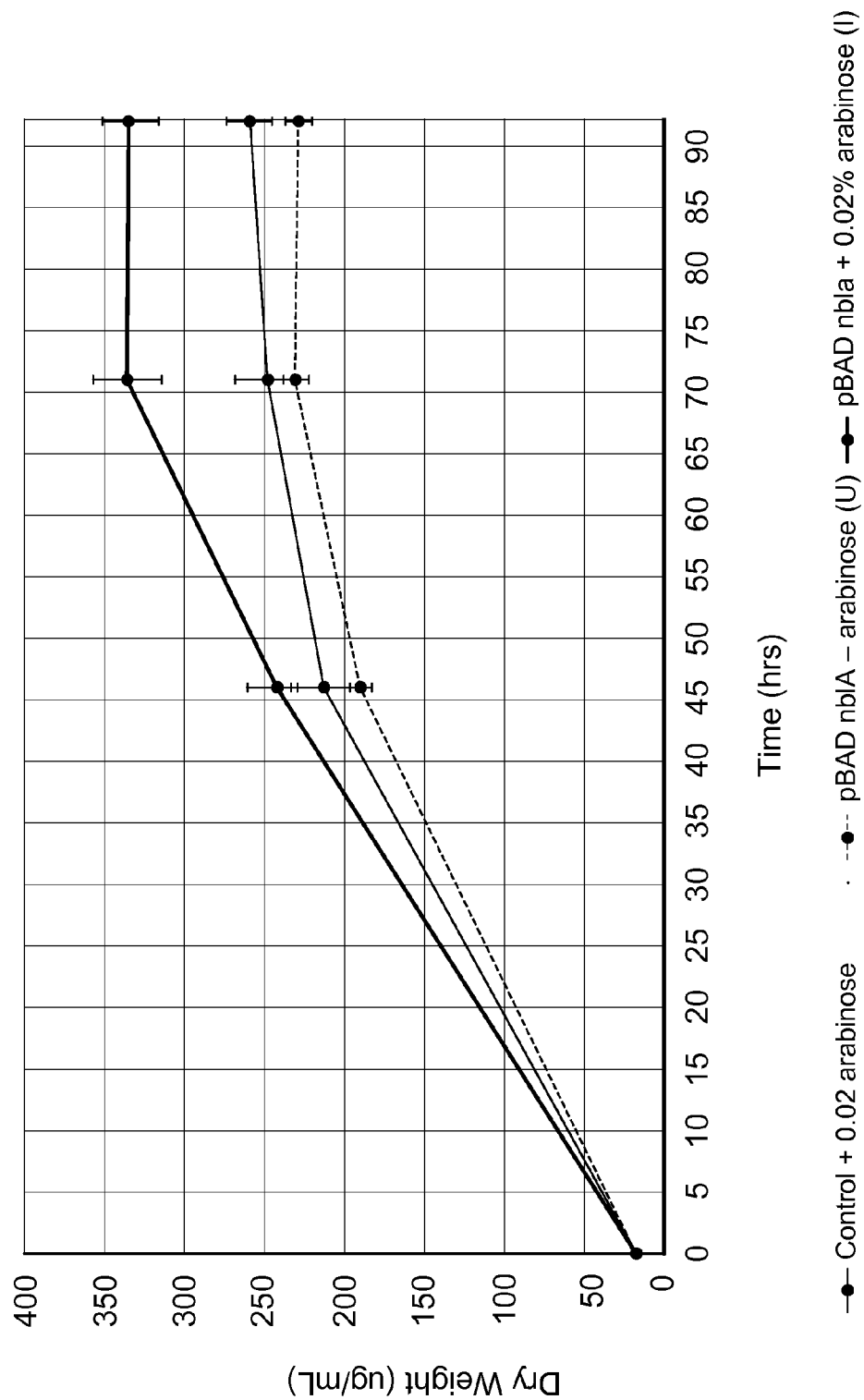

Cultures of a control strain (wild type *Synechococcus* sp. PCC7942) in the presence of 0.02% arabinose (which does not change optical characteristics in presence of arabinose), pBAD nblA, and pBAD nblA in the presence of 0.02% arabinose were grown in triplicate cultures at 30 degrees Celsius in photobioreactors (Phenometrics, USA), top lit with 2500 $pE*m^{-2}*s^{-1}$ incident white light LEDs with bubbling of 2% $CO_2$ in air. The medium used was BG-11+10 mM sodium phosphate (pH 7.1)+5 µg/mL Kanamycin (which all strains had resistance markers for). Strains with overexpression of nblA by induction with arabinose grew better than both controls as measured by optical density (OD 750 nm) and dry weight (normalized to culture volume) as shown in FIGS. 4A and B, respectively.

Example 4

Figure 5:
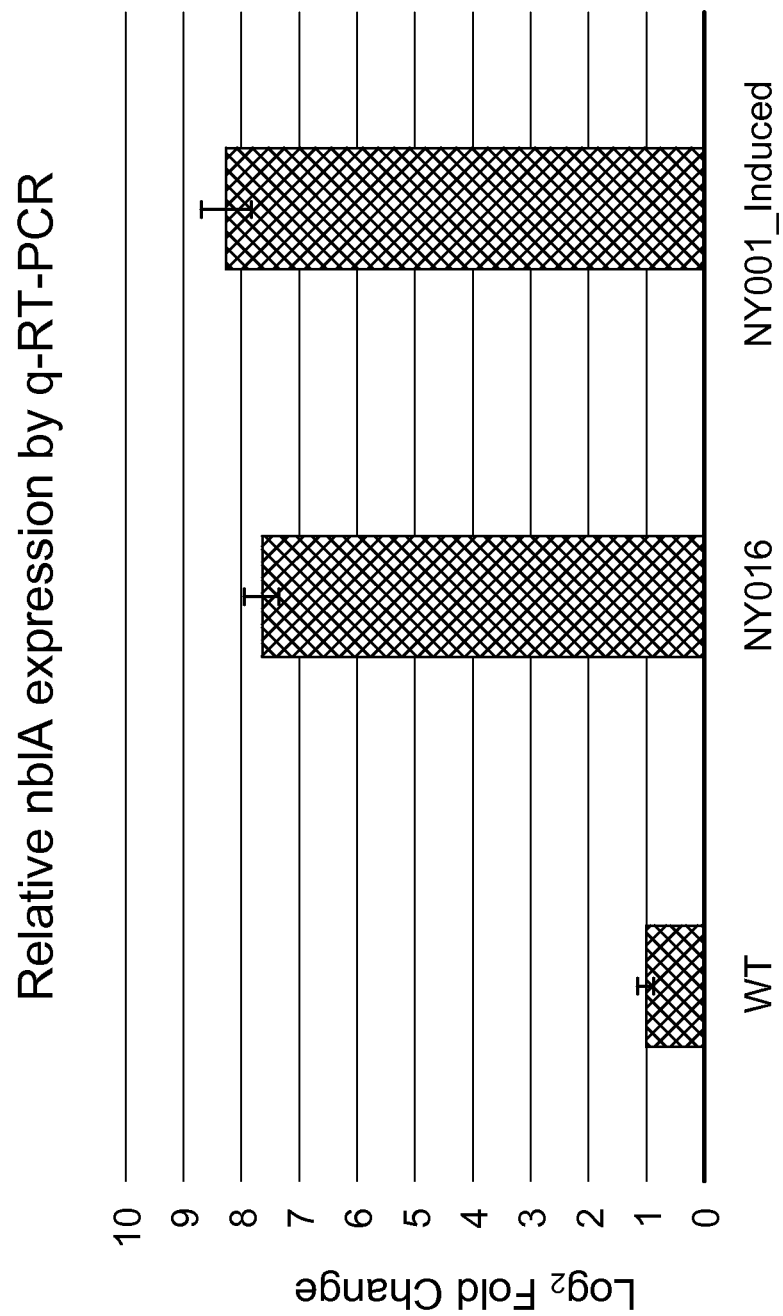
FIG. 5 shows relative expression ($log_2$ fold change) of total nblA transcripts for NY016 and NY001 (in the presence of 0.02% arabinose) versus wild-type as measured by q-RT-PCR. NY001 is a strain with a native copy of nblA gene behind its native promoter plus a second copy of nblA gene behind an arabinose inducible promoter (pBAD). NY016 is a strain with a native copy of the nblA gene behind its native promoter plus a second copy of nblA gene behind a constitutive high-expression promoter (pSYN-PCC7942_1306).

NY001, a strain of PCC7942 with a native copy of nblA gene behind its native promoter plus a second copy of nblA gene behind an arabinose inducible promoter (pBAD) has increased expression of total nblA gene expression relative to wild type as shown by q-RT-PCR. Also, NY016, a strain of PCC7942 with a native copy of the nblA gene behind its native promoter, plus a second copy of nblA gene behind a constitutive high-expression promoter (pSYN-PCC7942_1306) has a similar enhancement in total nblA gene expression. These observations are via quantitative reverse transcriptase polymerase chain reaction (q-RT-PCR) as shown in FIG. 5. For this experiment, triplicate cultures grown under moderate white light from cool-white fluorescent bulbs (light intensity approximately 120 pE*m-2*s-1) at 30 degrees Celsius in BG-11 media supplemented with 20 mM sodium phosphate (pH 7.1) and 0.02% L-arabinose for NY001_I. Samples from each culture were harvested in mid-log phase; cells were pelleted by centrifugation at 22,000×g for 5 minutes and supernatant was discarded. RNA was extracted from the remaining cell pellets and used to generate a cDNA library using a Qiagen Rneasy Mini Kit and the Rnase-free Dnase Set (Qiagen, USA). This cDNA library was used for q-RT-PCR, which was run relative to the rnpB housekeeping gene. Resulting relative expression levels are then shown as $\log_2$(fold change) of desired gene (in this case nblA) relative to a control (in this case wild-type ("WT")).

Figure 6:
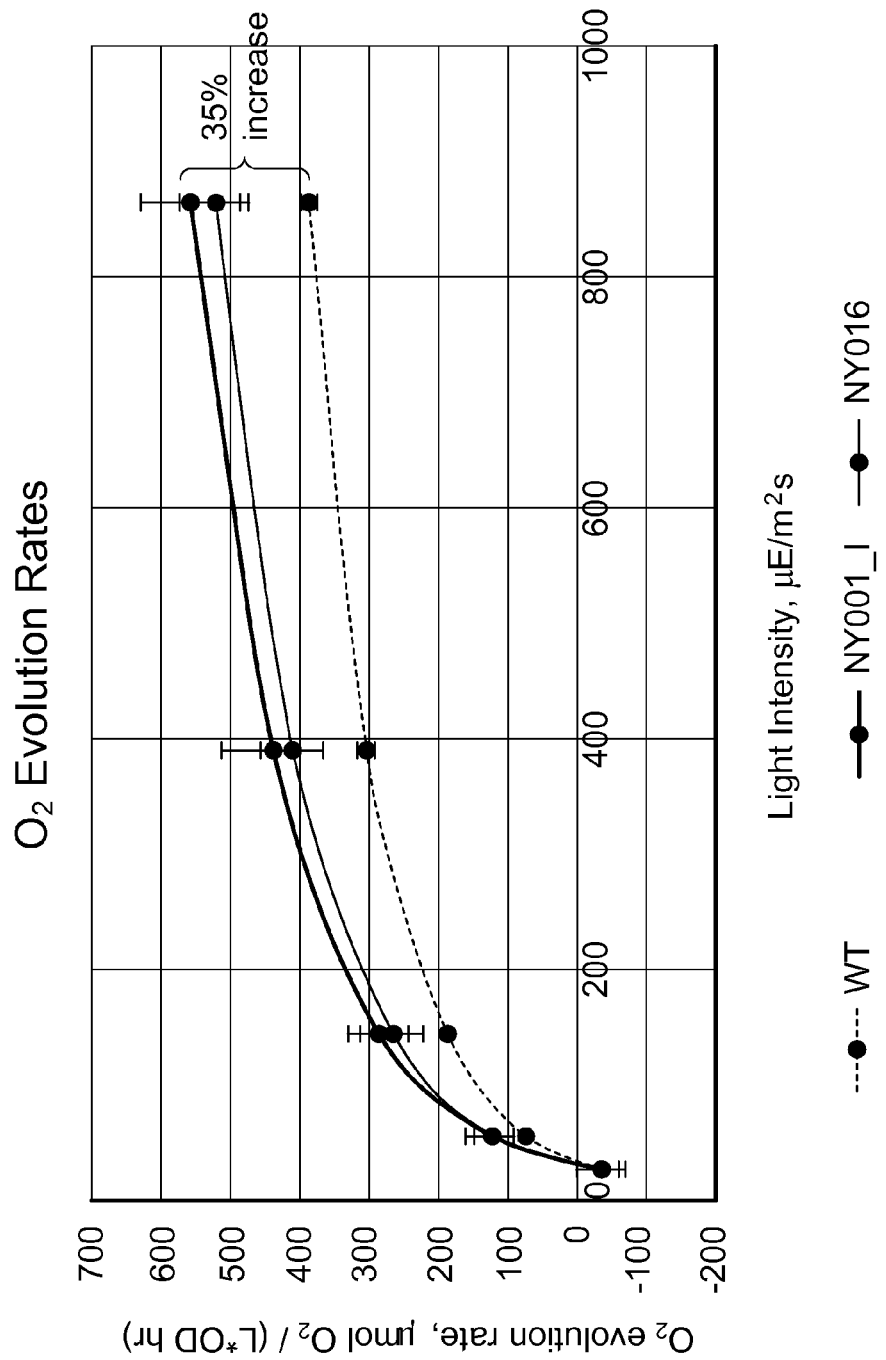
FIG. 6 shows normalized photosynthetic activities of wild-type (WT), pBAD nblA induced with 0.02% arabinose (NY001_I), and a strain constitutively overexpressing nblA (NY016) suspended in BG-11 medium with 20 mM Sodium Phosphate (pH 7.1) and 10 mM Sodium Bicarbonate added at OD750 values between 0.2 and 2.0.

Also, NY016 has increased photosynthetic activity, comparable to pBAD induced nblA (NY001_I) as measured by oxygen evolution rates shown in FIG. 6. Normalized photosynthetic activities of suspensions of wild type and NY016 were measured from triplicate cultures. Cells were harvested in log-phase (between $OD_{750}$ values of 0.4 and 0.6) and re-suspended in BG-11 medium with 20 mM Potassium Phosphate (pH 7.5) and 10 mM Sodium Bicarbonate additions. These suspensions were illuminated with Red+Blue LEDs in a calibrated Walz Dual Pam 100 Fluorometer (Walz, Germany) to total light intensities between 0 and 1000 $pE*m^{-2}*s^{-1}$ and oxygen concentration was monitored by a NeoFox Oxygen Sensor (Ocean Optics, USA) continuously every second for 120 seconds at each light intensity. The slope of the linear $O_2$ production rate was then found and plotted above for each culture time (n=3 for each type).

Figure 7A:
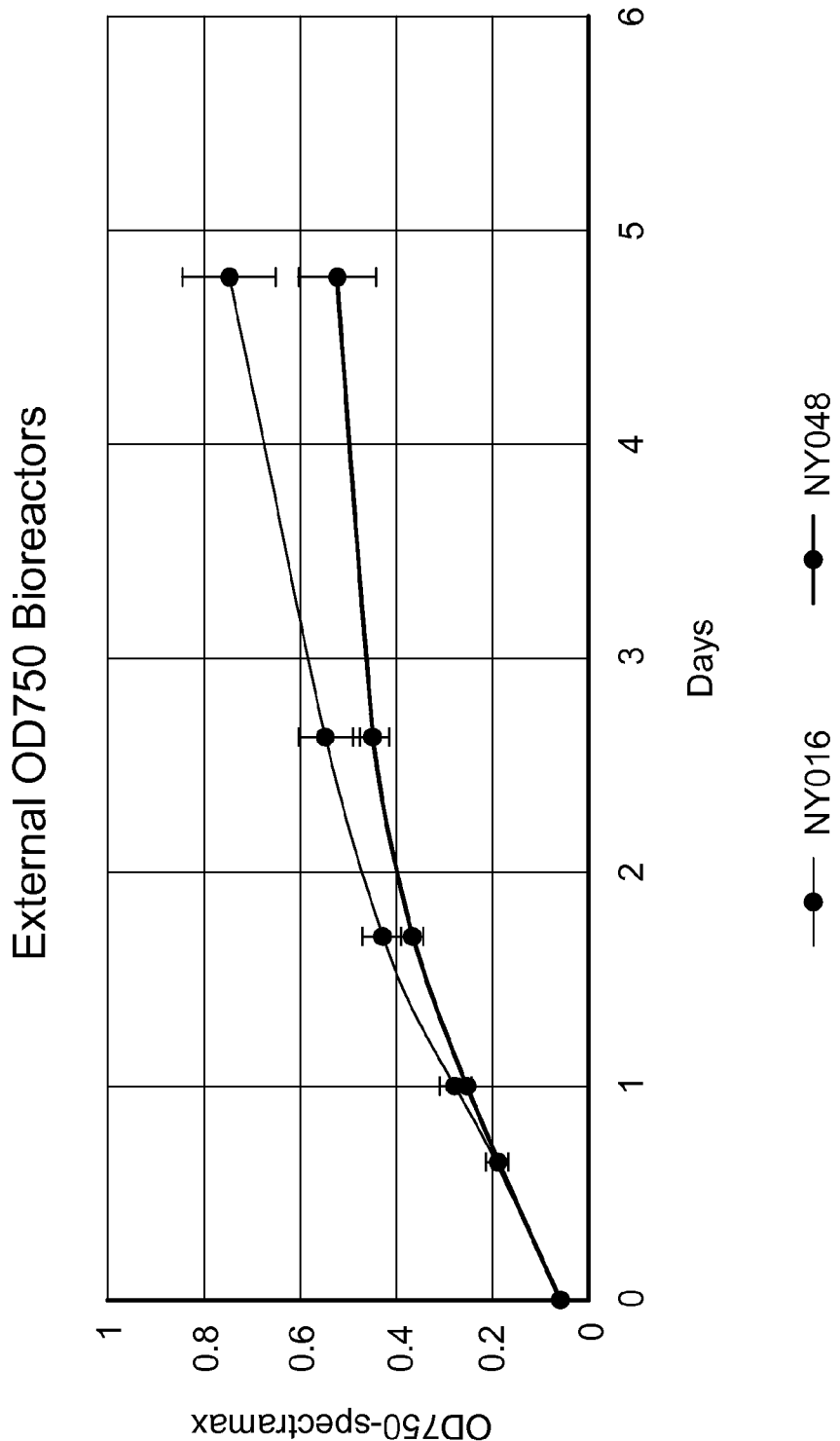
FIGS. 7A and 7B show growth of a control strain (NY048) and NY016 in photobioreactors as monitored by Optical Density (FIG. 7A) and dry weight (FIG. 7B). Optical density was measured by taking aliquots of culture and measuring absorbance at 750 nm. Dry weight was measured by weighing 0.2 micron pre-weight filters with dried cells from 5-10 mL culture aliquots.
Figure 7B:
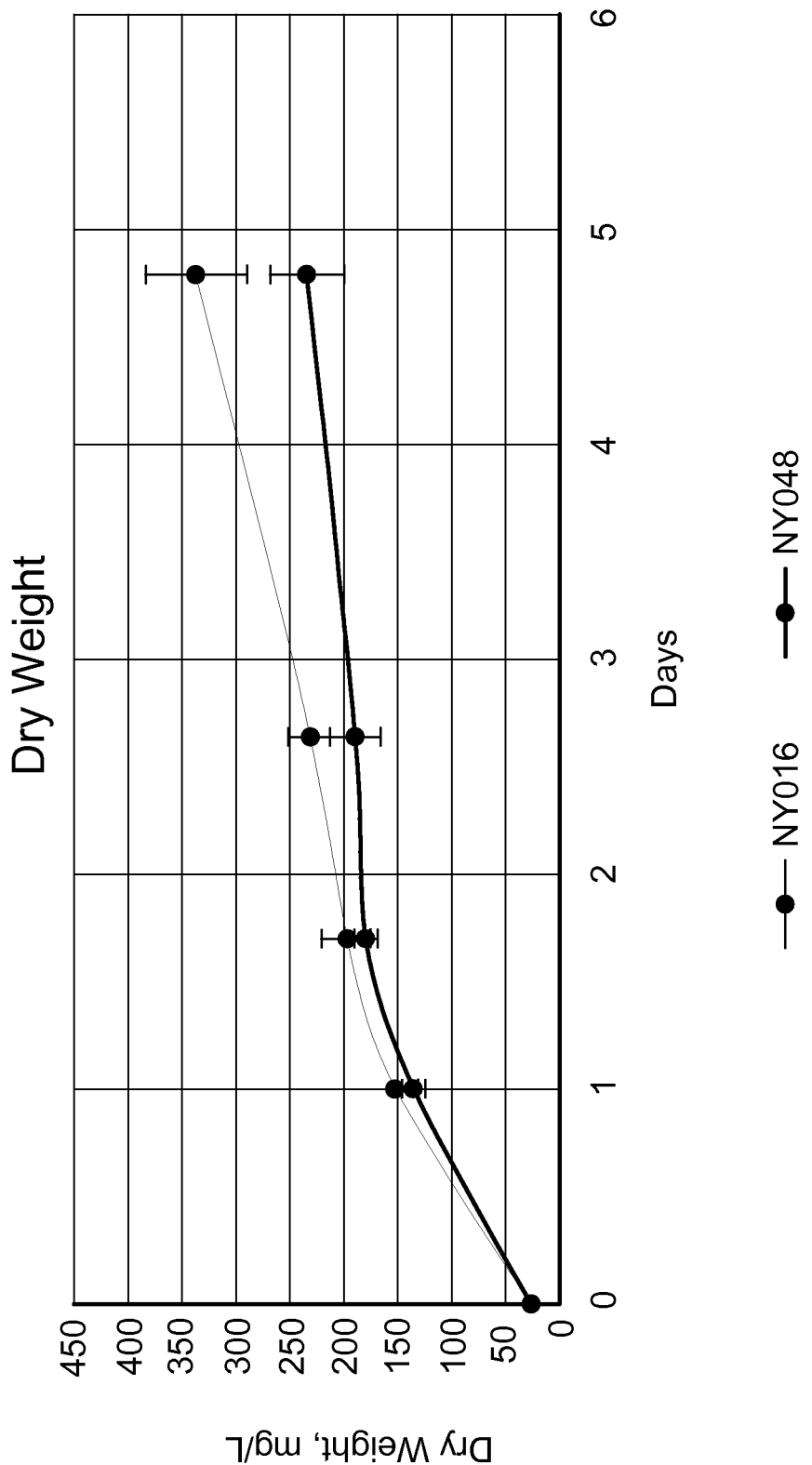
Figure 8:
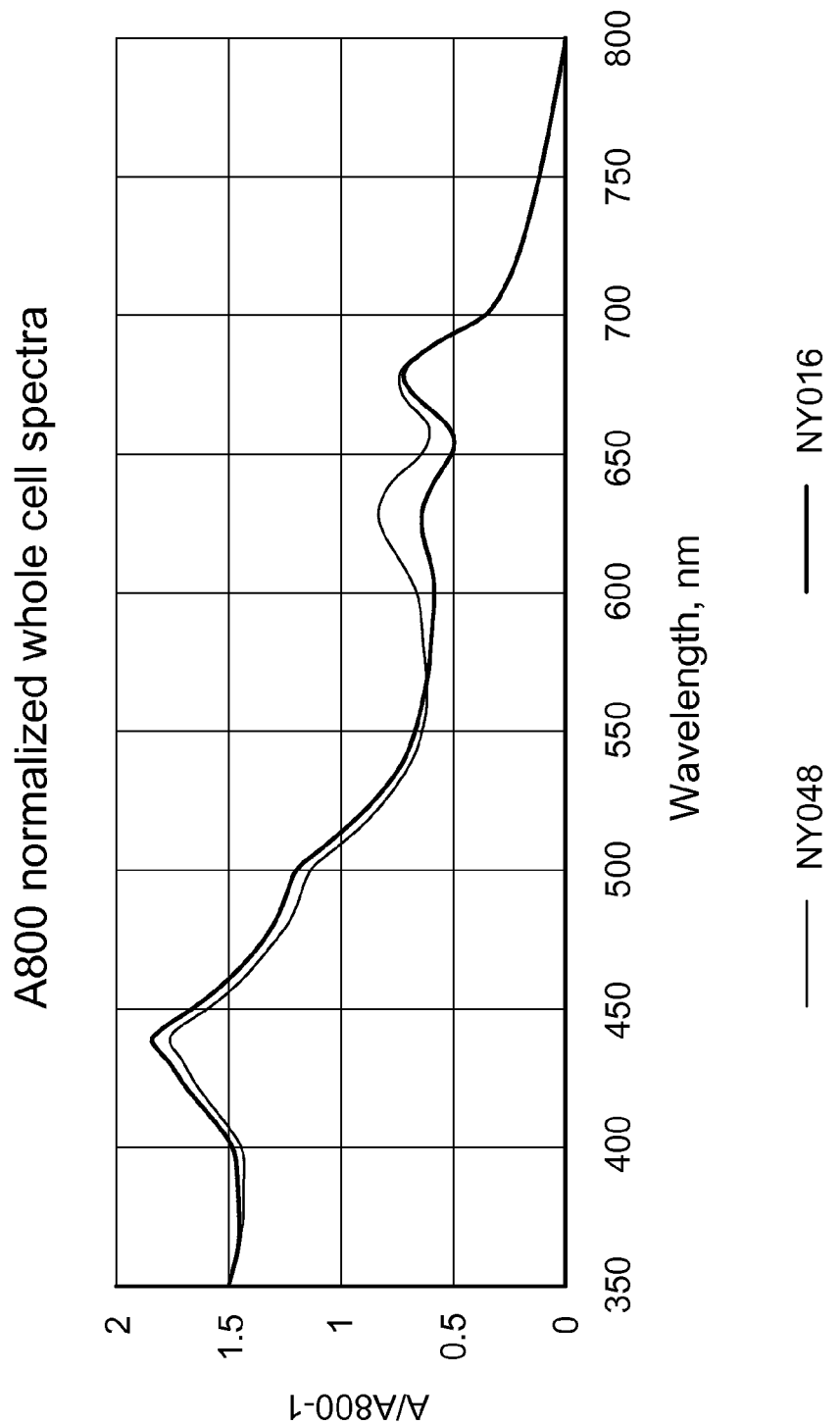
FIG. 8 shows representative normalized whole-cell absorbance spectra of control strain (NY048) and strain with constitutive overexpression of nblA (NY016). Absorbances were normalized by taking the absorbance value at each wavelength (A) and dividing by the absorbance value at 800 nm (A800) and subtracting 1 from that ratio.

NY016 also grows faster and to higher densities than the control strain NY048 (containing only the native copy of nblA behind its native promoter; it is a wild-type like strain with an added cassette for antibiotic resistance only) as shown in FIG. 7. Here, Cultures of a control strain (which contains only native nblA gene) and NY016 (which contains the native nblA gene plus a second, overexpressed copy of the nblA gene) were grown in triplicate cultures at 30 degrees Celsius in photobioreactors (Phenometrics, USA), top lit with 2500 $pE*m^{-2}*s^{-1}$ incident white light LEDs with bubbling of 2% $CO_2$ in air. The medium used was BG-11+10 mM sodium phosphate (pH 7.1)+2 μg/mL spectinomycin+2 μg/mL streptomycin (which both NY016 and NY048 have resistance markers for). NY016 grew better than control (NY048) as measured by optical density (OD 750 nm) and dry weight (normalized to culture volume) as shown in FIGS. 7A and 7B, respectively. Whole-cell spectra were taken with a spectrophotometer of aliquot samples from these reactors part way through the experiment (between day 2 and day 3) to verify that decreased absorbance was seen at and around 630 nm due to decreases in phycobilins from these samples. Representative normalized spectra are shown in FIG. 8 from these samples.

Example 5

Figure 9:
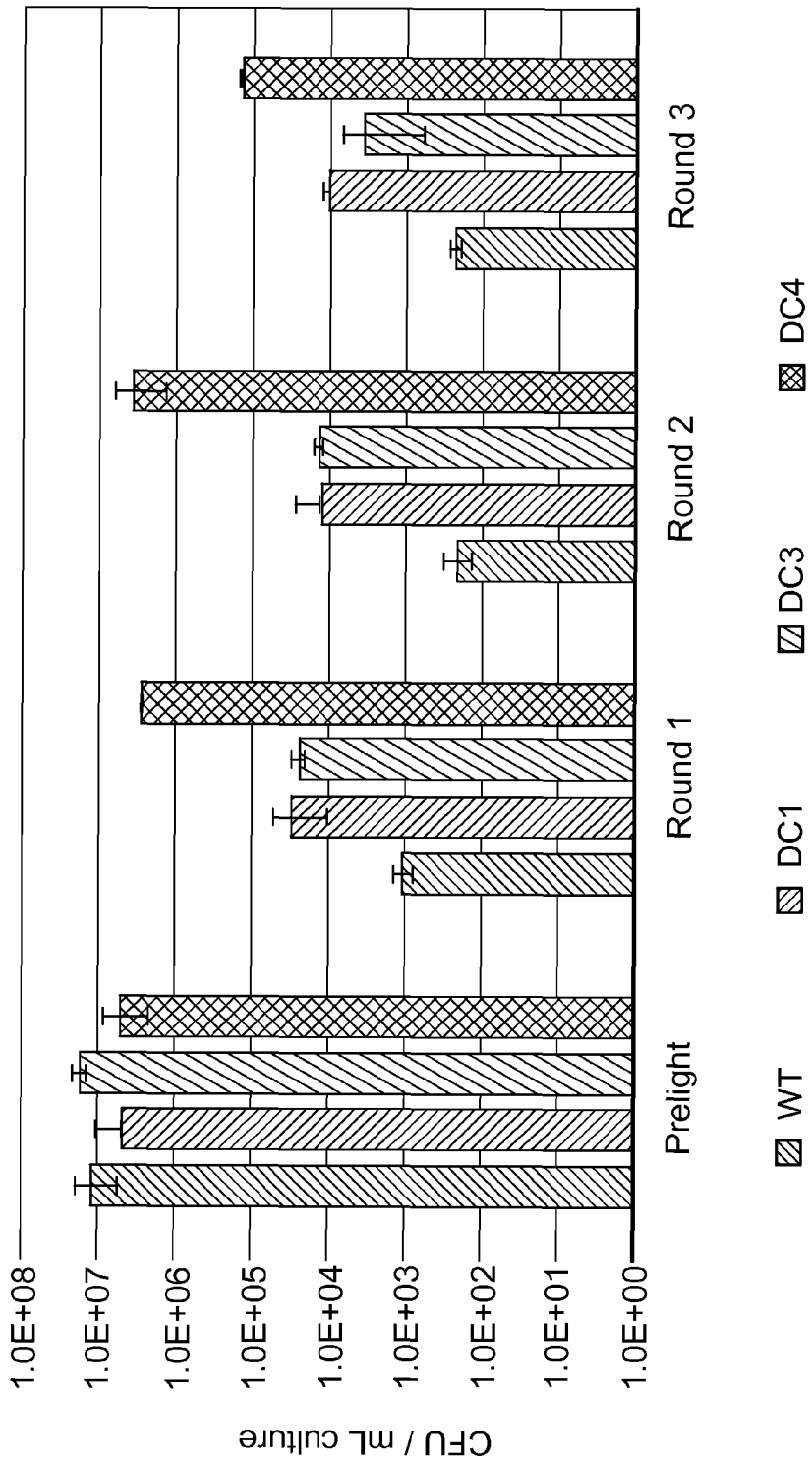
FIG. 9 shows High Light Kill Curve using WT and High Light (HL) mutants DC1, DC3 and DC4. Cultures of these strains were cultured and diluted to 0.1 $OD_{750} \approx 1.0*10^7$ cells/mL (Colony forming units (CFU's)/mL shown as "pre-light"). Samples were then exposed to >3000 $pE*m^{-2}*s^{-1}$ white LED light for 3 exposures (rounds 1-3) each for 1 hour. After each round, culture aliquots were plated and CFUs were counted from cultured plates ~1 week later. WT has the strongest decrease in cell density following treatment rounds.
Figure 10:
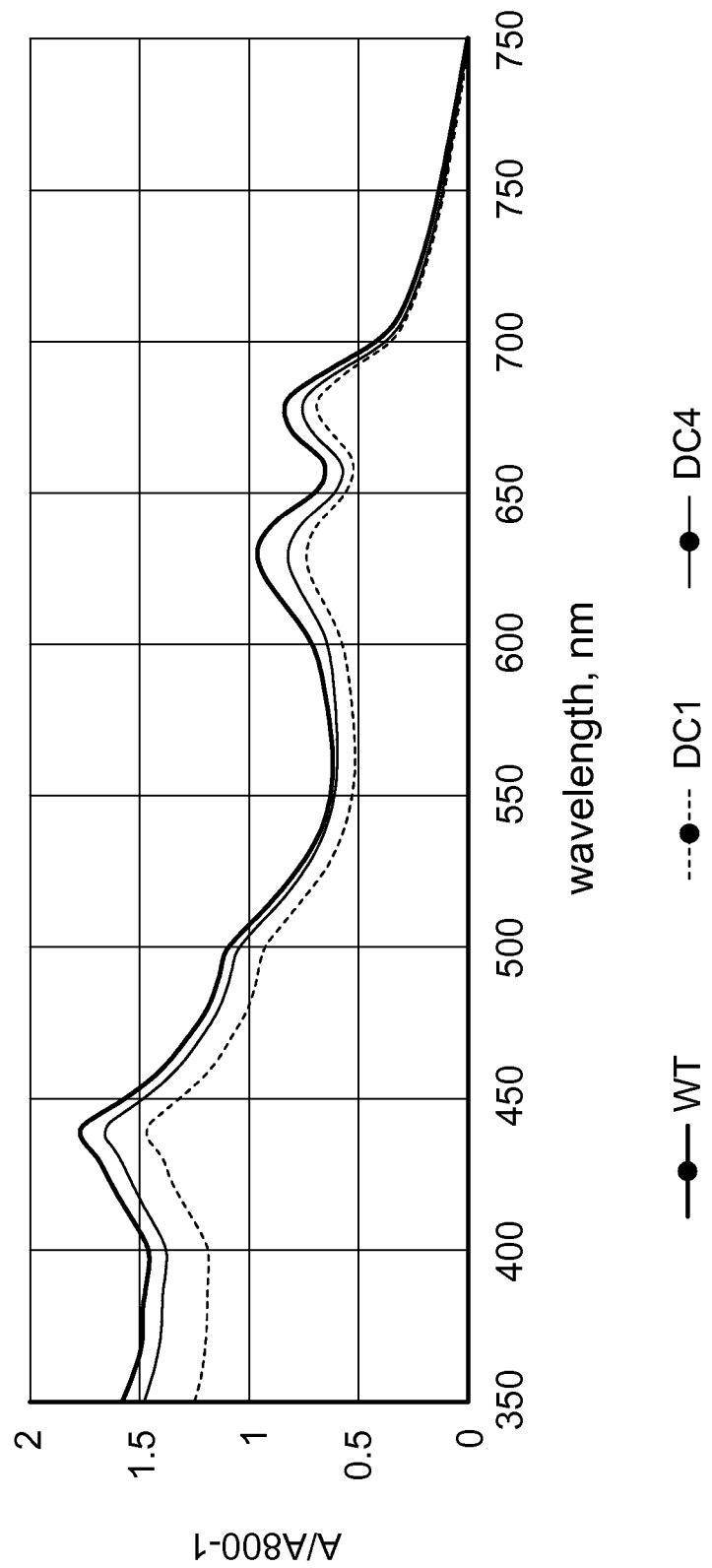
FIG. 10 shows normalized spectra of high-light resistant mutants (HL mutants) DC1 and DC4 relative to WT. Absorbances were normalized by taking the absorbance value at each wavelength (A) and dividing by the absorbance value at 800 nm (A800) and subtracting 1 from that ratio.
Figure 11:
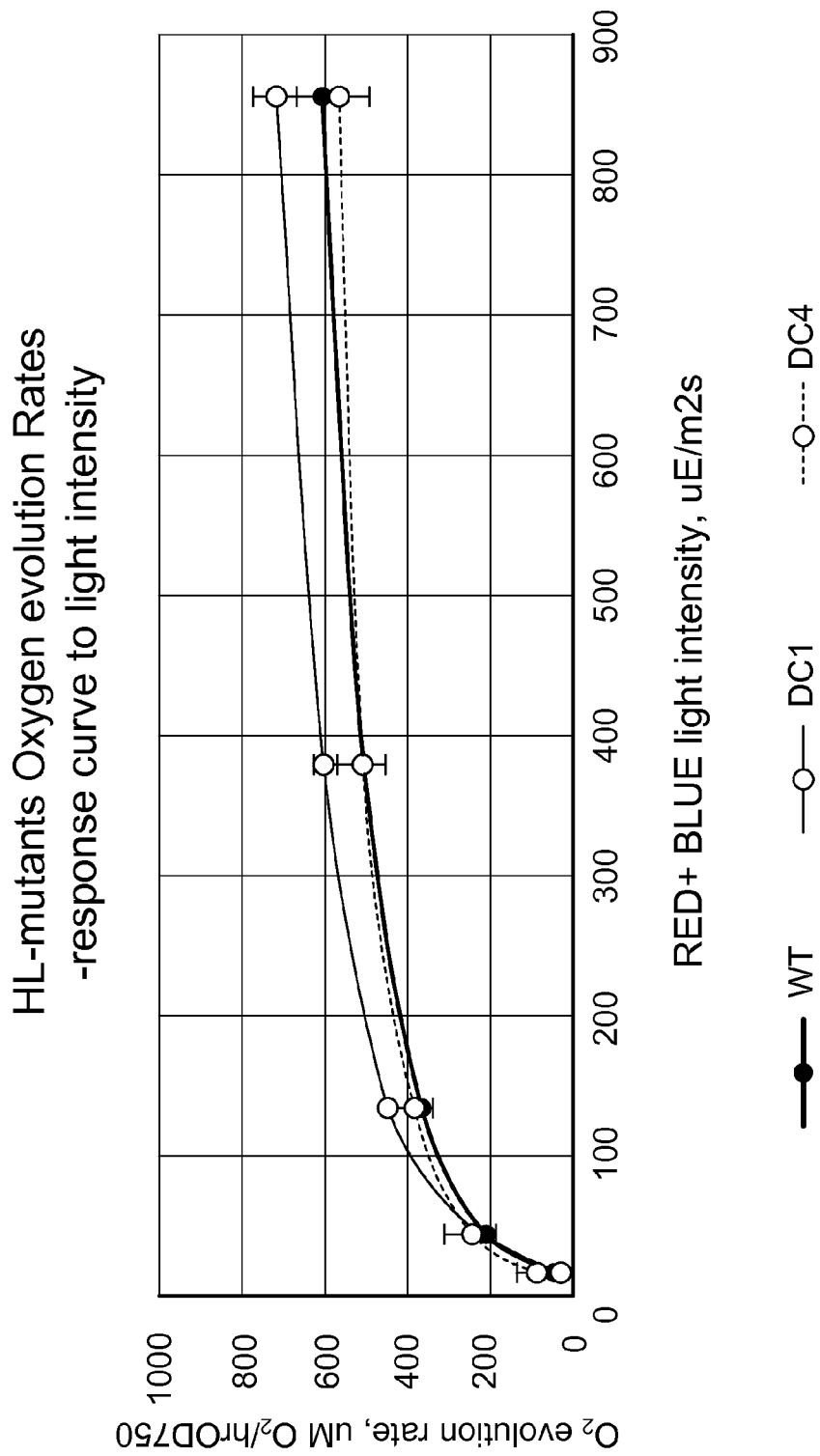
FIG. 11 shows photosynthetic activities as measured by oxygen evolution for high-light mutants DC1 and DC4 versus WT.

Screening of natural mutants in populations of wild-type Synechococcus sp. PCC 7942 for resistance to increased light was achieved by killing cultures of S7942 with high light treatment (>3000 $iE*m^{-2}*s^{-1}$ white LED light) and plating survivors on agar plates. To achieve killing, cultures of wild-type presumed to contain a natural sub-population of mutants were grown at 30 degrees Celcius to log-phase (approximately 0.5 $OD_{750}$) and resuspended at 0.1 $OD_{750}$ in 50 mL volumes in glass bottles. The glass bottles were covered on one side with aluminum foil to reflect incoming light. The bottles were placed in a transparent water bath which was up against a panel of white LEDs. The LEDs were turned on for 1 hour while samples in glass bottles were bubbled with air for agitation. The LED panels were turned off for 1 hour and then a second high-light treatment was achieved by exposing the same samples to the on LEDs. Three rounds of high light exposure in total were performed. The remaining culture after three rounds was spread on agar plates and left to grow under moderate (approximately 100 $iE*m^{-2}*s^{-1}$ light from cool white fluorescent bulbs). Cells that grew with discoloration were considered mutants. At least three mutants isolated when cultured and treated by light have a lower fraction of cell death induced by high light treatment as shown in FIG. 9. For FIG. 9, high light treatments were performed on WT, and mutants isolated from the procedure as described above. This procedure was repeated for WT, and mutants DC1, DC3 and DC4, and glass bottles were sampled for plating of small aliquots before and after each round of high light exposure to follow cell-death by high light. FIG. 9 shows that WT cell viability (as measured by Colony forming units (CFUs) per mL of culture in the glass bottles drops from $10^7$ to about $10^2$ while mutants have higher CFUs after 3 rounds of killing. Two of these mutants, DC1 and DC4 have decreased absorbances in pigment regions relative to WT as shown in FIG. 10, which shows a normalized whole-cell spectrum taken as from whole-cell suspensions of actively growing cultures of the strains. DC1 was shown to have an improved normalized oxygen evolution rate response to light than WT and DC4 as shown in FIG. 11. For this experiment, triplicate cultures of wild-type 57942, and mutants DC1 and DC4 were harvested in log-phase (between OD750 values of 0.4 and 0.6) and re-suspended in BG-11 medium with 20 mM Potassium Phosphate (pH 7.5) and 10 mM Sodium Bicarbonate additions. These suspensions were illuminated with Red+Blue LEDs in a calibrated Walz Dual Pam 100 Fluorometer (Walz, Germany) to total light intensities between 0 and 900 $\mu E*m^{-2}*s^{-1}$ and oxygen concentration was monitored by a NeoFox Oxygen Sensor (Ocean Optics, USA) continuously every second for 120 seconds at each light intensity. The slopes of the linear $O_2$ production rate was then found and plotted above for each culture time (n=3 for each type).

Example 6

Figure 12:
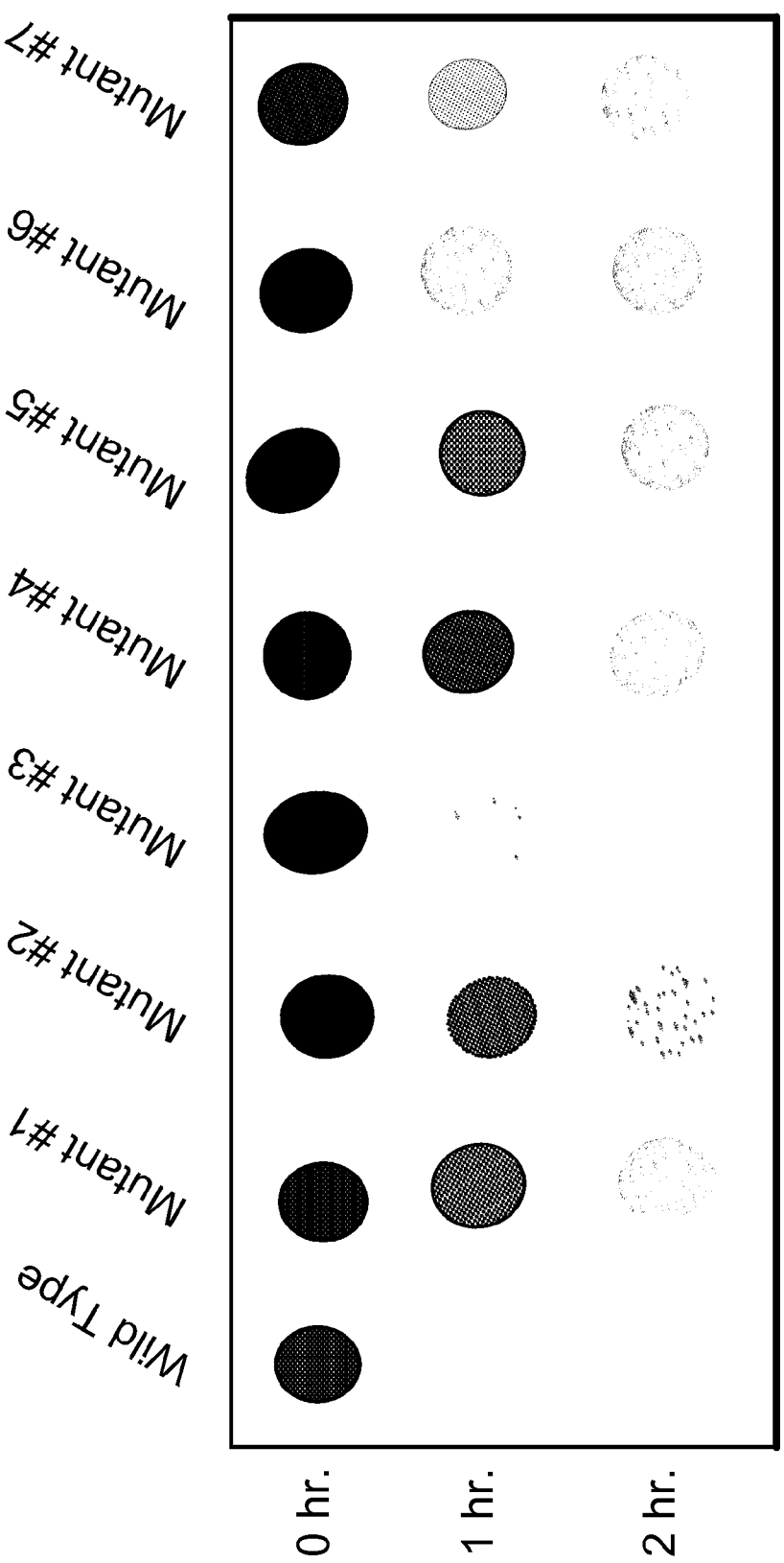
FIG. 12 shows candidate metronidazole (MZ) resistant mutants. Cultures of the wild type and metronidazole (MZ) resistant mutants were incubated with 4 mM MZ for the times indicated on the left side. Five μL of culture (~5000 cells) were spotted from each flask and grown on BG-11 plate at a light intensity of 100 $pE*m^{-2}*s^{-1}$.

Screening of natural mutants in populations of wild-type Synechococcus sp. PCC 7942 for resistance to metronidazole was achieved by killing cultures of S7942 with metronidazole treatment and plating survivors on agar plates. Wild-type cells presumed to contain a natural sub-population of mutants were grown in BG11, suspended at a cell concentration of $1\times10^6$ cells/mL and treated with 4 mM metronidazole for 1-2 hours under moderate light from cool white fluorescence bulbs at a light intensity of approximately 200 μmoles photons $m^{-2}$ $s^{-1}$. The resulting culture was plated on agar plates incubated at a light intensity of 100 μmoles photons $m^{-2}$ $s^{-1}$ to grow survivors. At least seven mutants isolated from single colonies of the plates from the screen when again cultured and treated with metronidazole have a lower fraction of cell death induced by metranidazole treatment as shown in FIG. 12. Here, cultures of the WT and metronidazole (MZ) resistant mutants (1×10⁶ cells/mL) were incubated with 4 mM MZ for 0, 1 and 2 hours. Five μL of culture (~5000 cells) were spotted from each flask and grown on BG-11 plate at a light intensity of 100 μmoles photons $m^{-2} s^{-1}$.

Example 7

Figure 13:
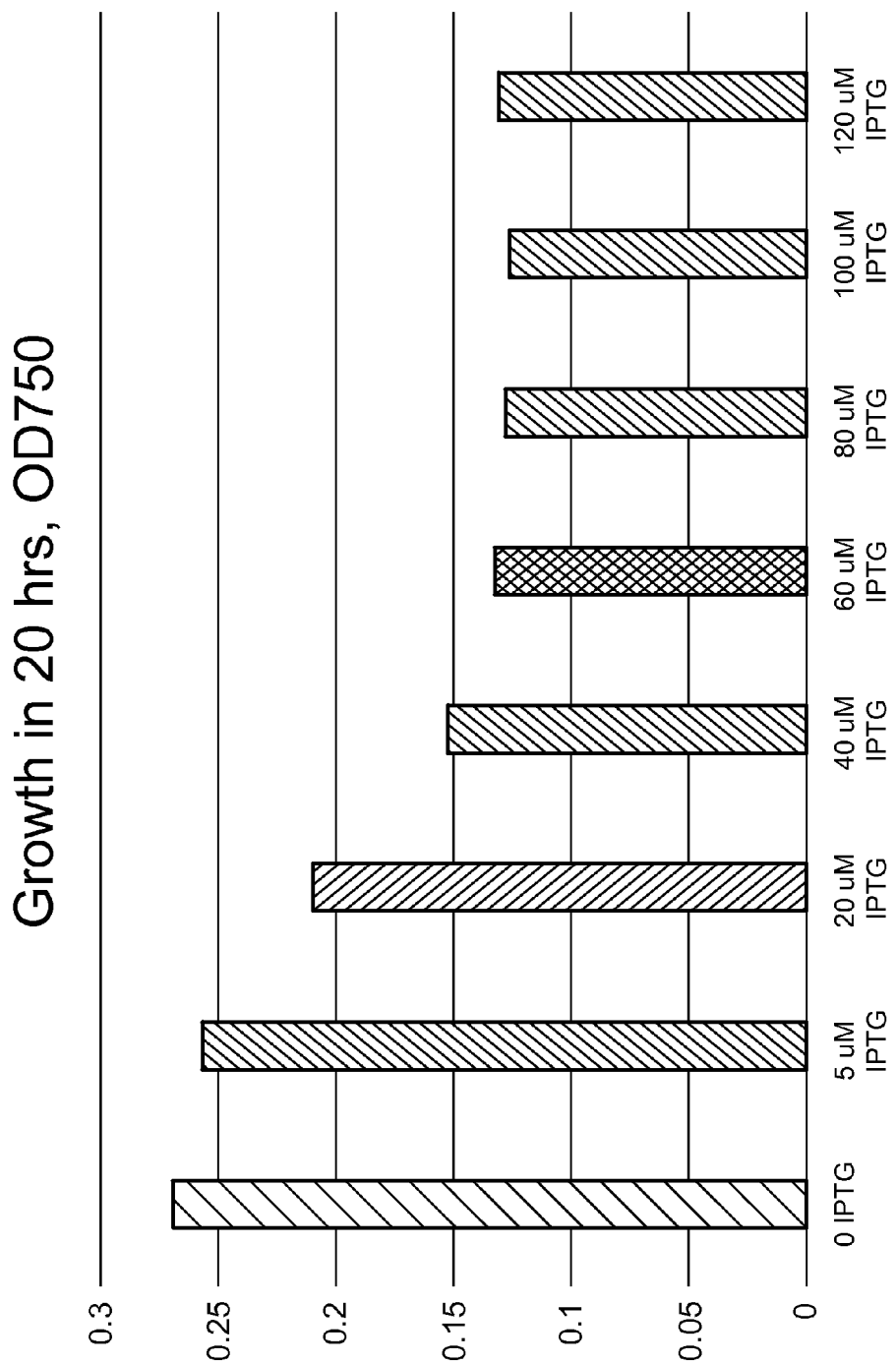
FIG. 13 shows a plot of OD750 values of NY056 grown in BG11+20 mM NaPi+0, 5, 20, 40, 60, 80, 100, or 120 uM isopropyl-β-D-1-thiogalactopyranoside (IPTG) (singlet cultures).
Figure 14:
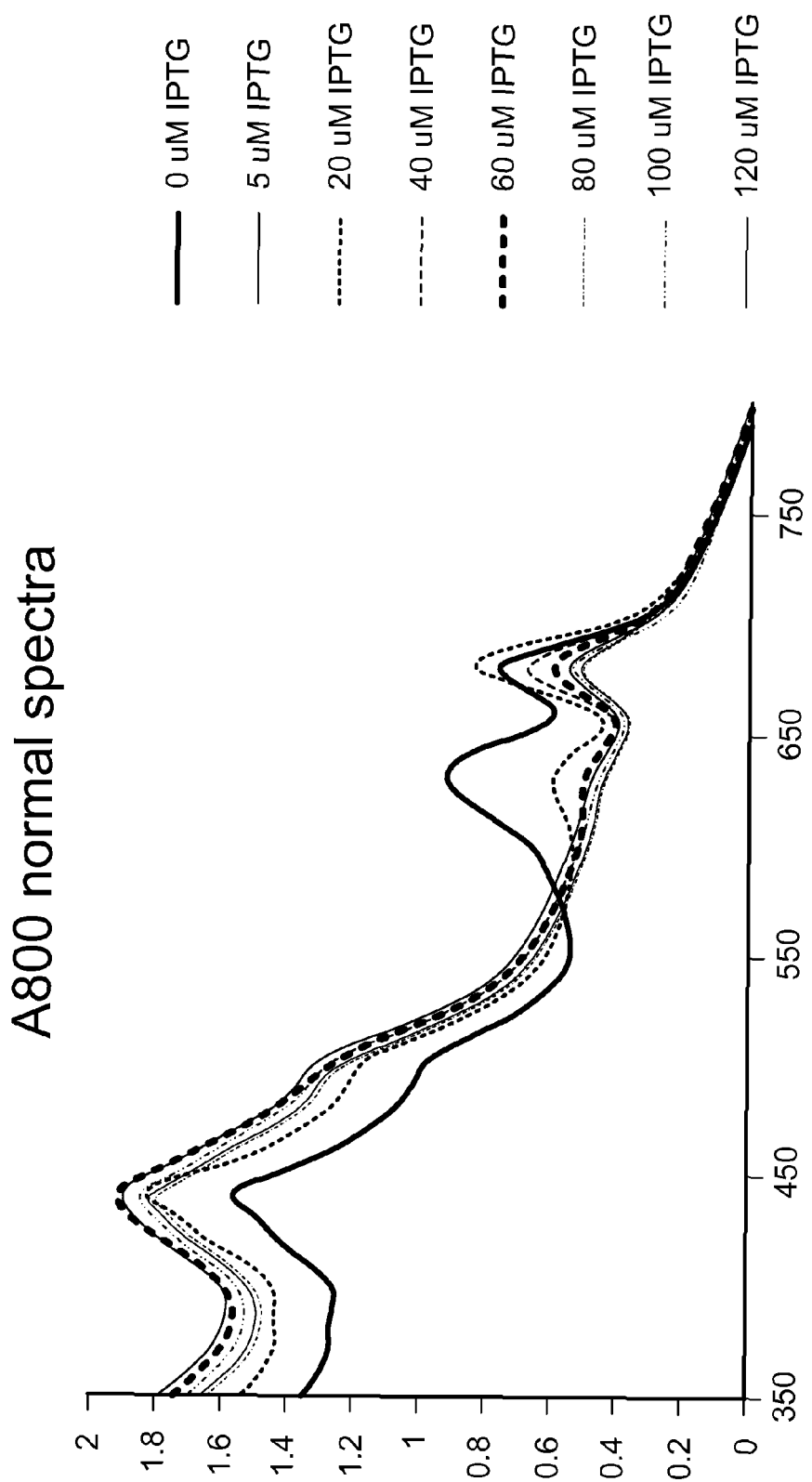
FIG. 14 shows a spectra of these cultures from FIG. 13 normalized to A800.

NY056 [a strain of PCC7942 having a markerless deletion of nblA strain (NY052) with nblA behind pTrc added to neutral site 4] were grown in BG11+20 mM NaPi+0, 5, 20, 40, 60, 80, 100, or 120 uM isopropyl-β-D-1-thiogalactopyranoside (IPTG) (singlet cultures). Cultures were inoculated from log-phase culture of NY056 (no IPTG) at 0.05 OD after 20 hours, OD750 values were as plotted as shown in FIG. 13. The spectra of these cultures normalized to A800 were as shown in FIG. 14.

Two trends were noted. First, a strong trend of bilin decrease and, second, a weaker (with respect to IPTG addition) trend of chlorophyll decreases at 680 nm (but not 420 nm).

Figure 15:
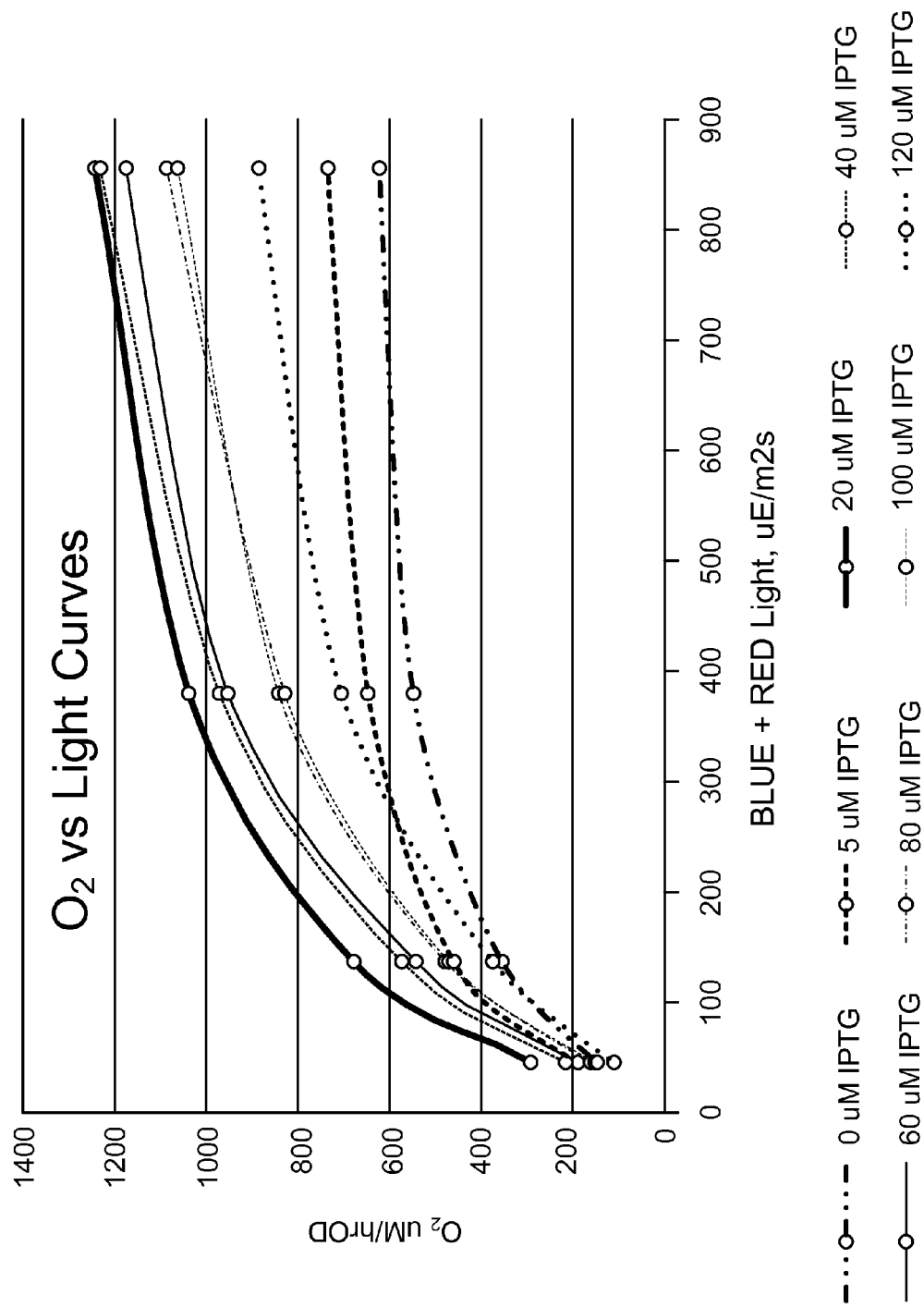
FIG. 15 shows plotted $O_2$ evolution curves of the cultures from FIG. 13 in the WALZ dual PAM 100 after ~30 hours growth for cells resuspended at ~2.0 OD750 in BG11+20 mM NaPi+10 mM NaHCO3.

After ~30 hours growth, $O_2$ evolution curves in the WALZ dual PAM 100 were observed for cells resuspended at ~2.0 OD750 in BG11+20 mM NaPi+10 mM NaHCO3. The curves are plotted and shown in FIG. 15. As shown in FIG. 15, there is a dramatic, nearly 2-fold increase in $O_2$ evolution for cultures in 20 uM IPTG versus control (0 IPTG).

Figure 16:
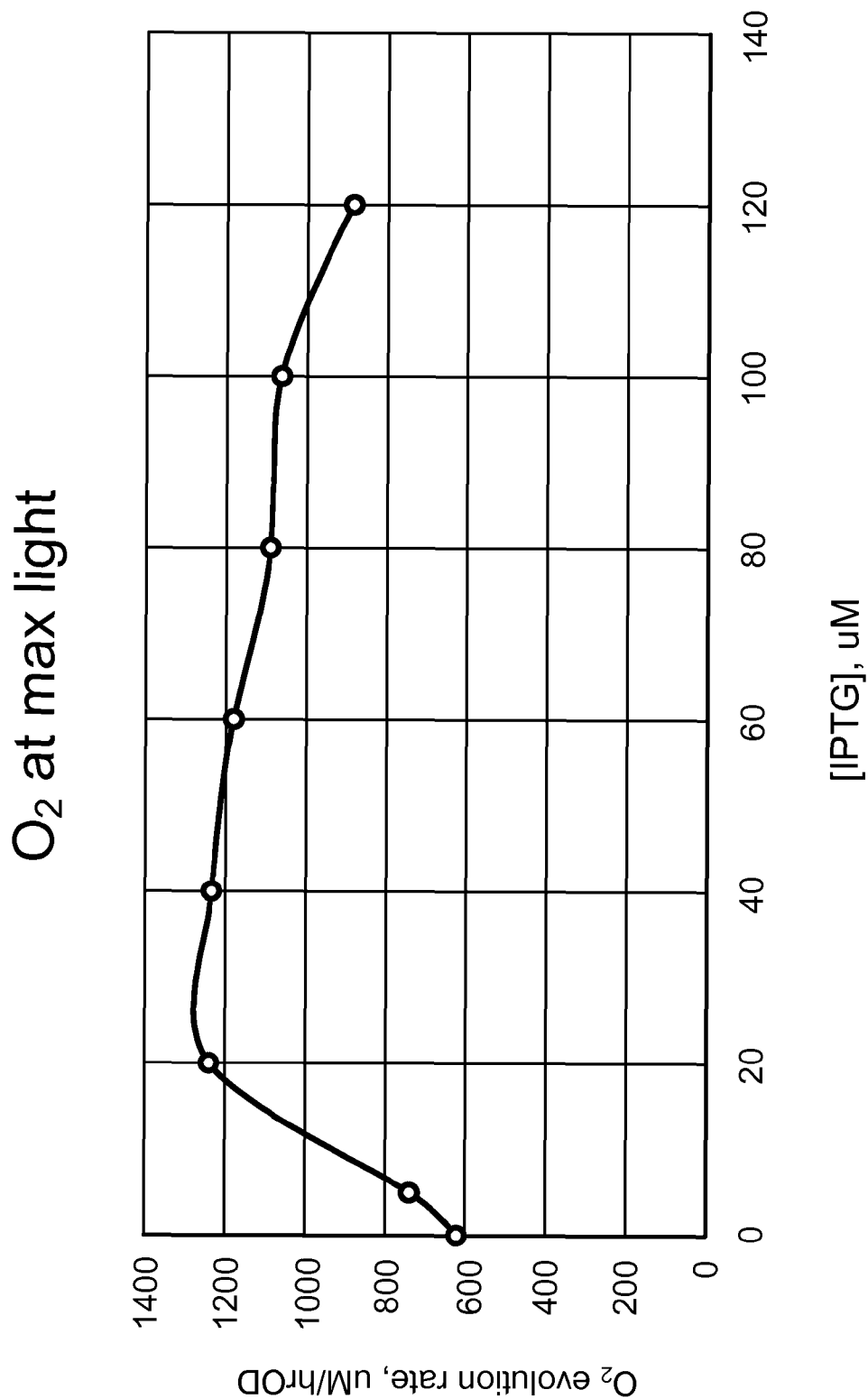
FIG. 16 shows a plot of the maximum light $O_2$ evolution for each culture of FIG. 15 at varying IPTG.

To better visualize the trend of $O_2$ evolution vs IPTG added for growth, just the maximum light $O_2$ evolution for each culture at varying IPTG was plotted as shown in FIG. 16. FIG. 16 shows a striking relationship between bilin decrease and $O_2$ evolution increase versus chlorophyll decrease and $O_2$ gradual decrease.

Figure 17:
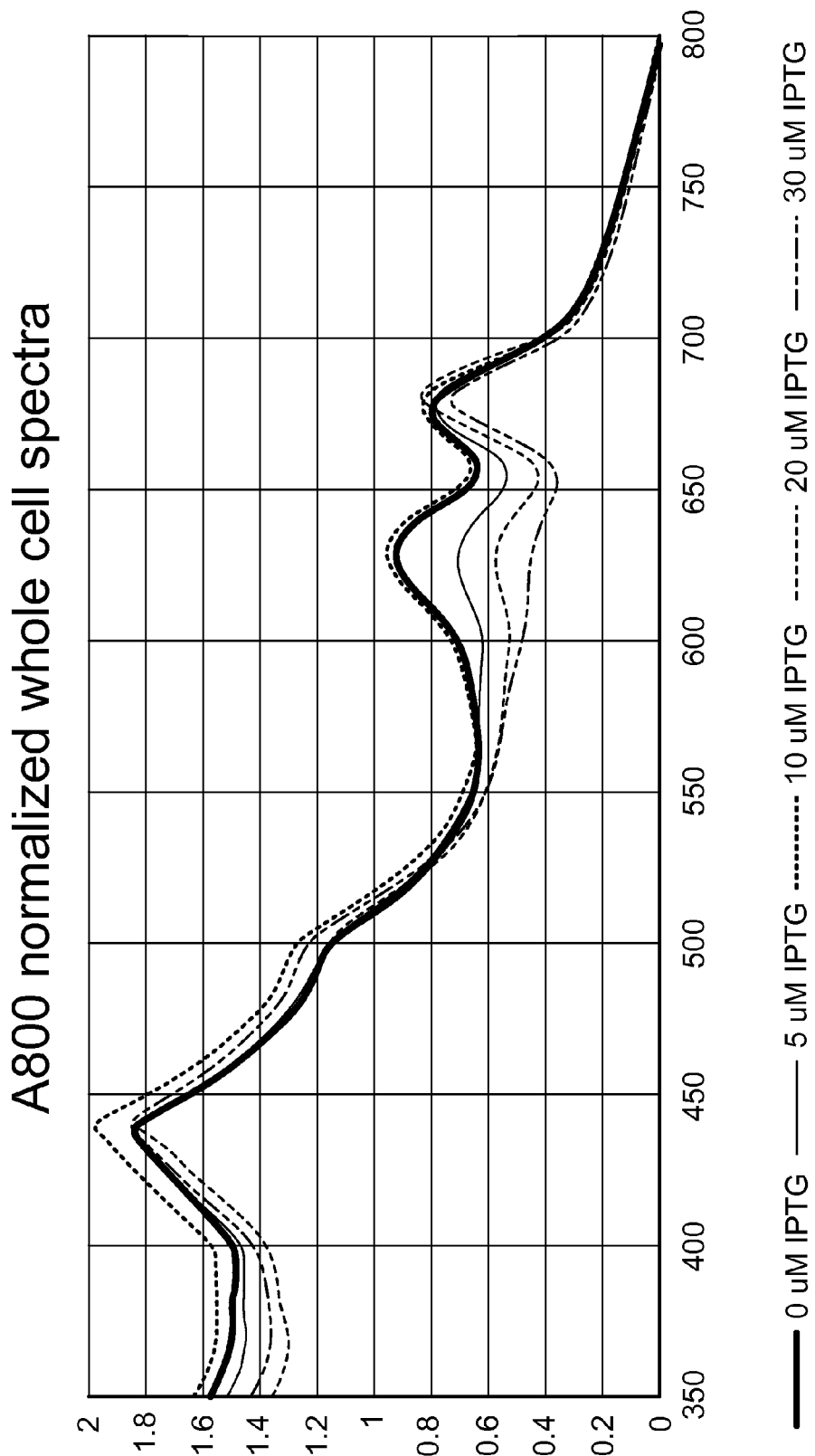
FIG. 17 shows the A800-normalized spectra of cultures grown for 30+ hrs in BG11+20 mM NaPi+0, 5, 10, 20, and 30 uM IPTG with NY056 in BG11+20 mM NaPi+0, 5, 10, 20, and 30 uM IPTG (singlet cultures).
Figure 18:
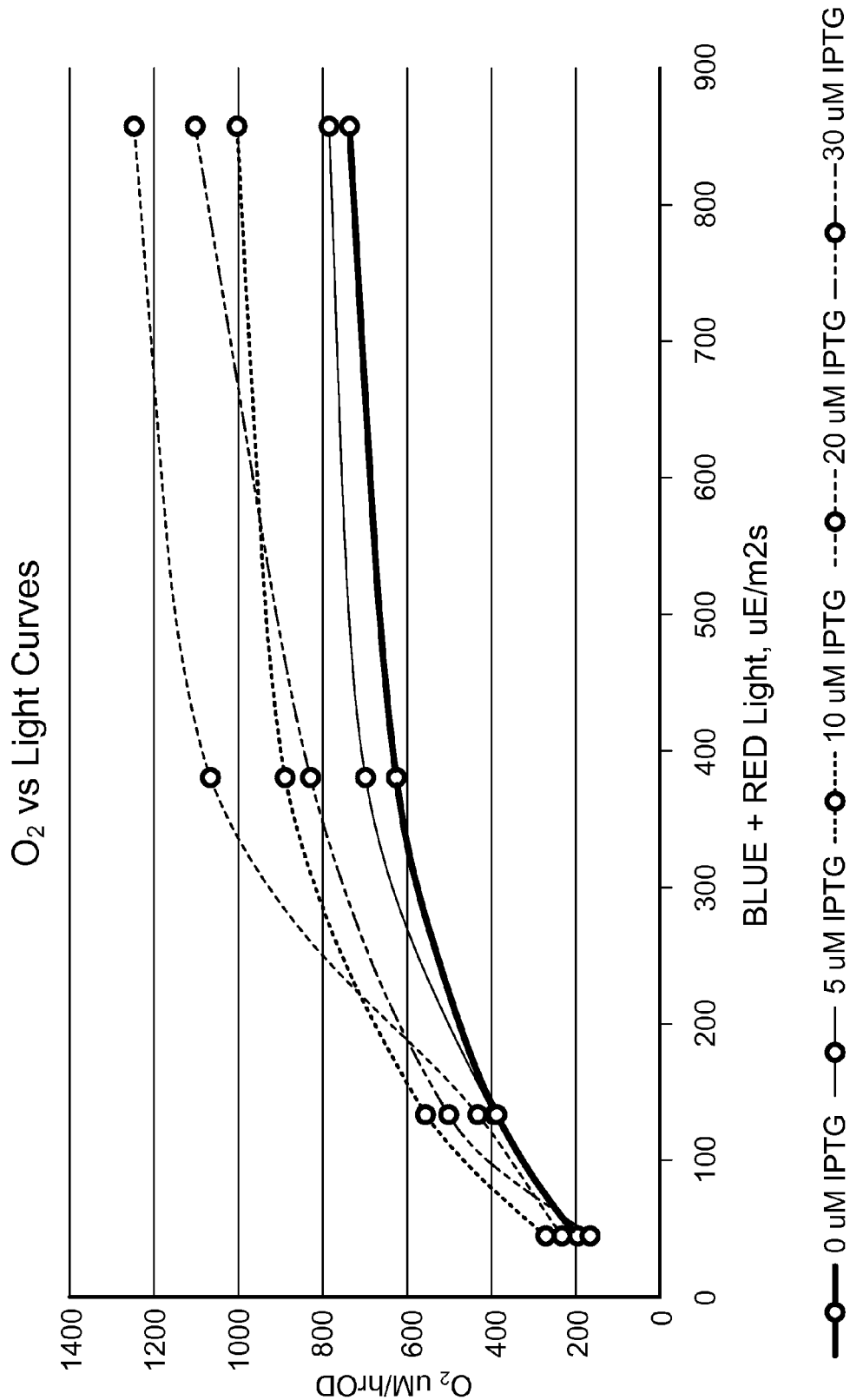
FIG. 18 shows shows plotted $O_2$ evolution curves of the cultures from FIG. 17 in the WALZ dual PAM 100 after ~30 hours growth for cells resuspended at ~2.0 OD750 in BG11+20 mM NaPi+10 mM NaHCO3.
Figure 19:
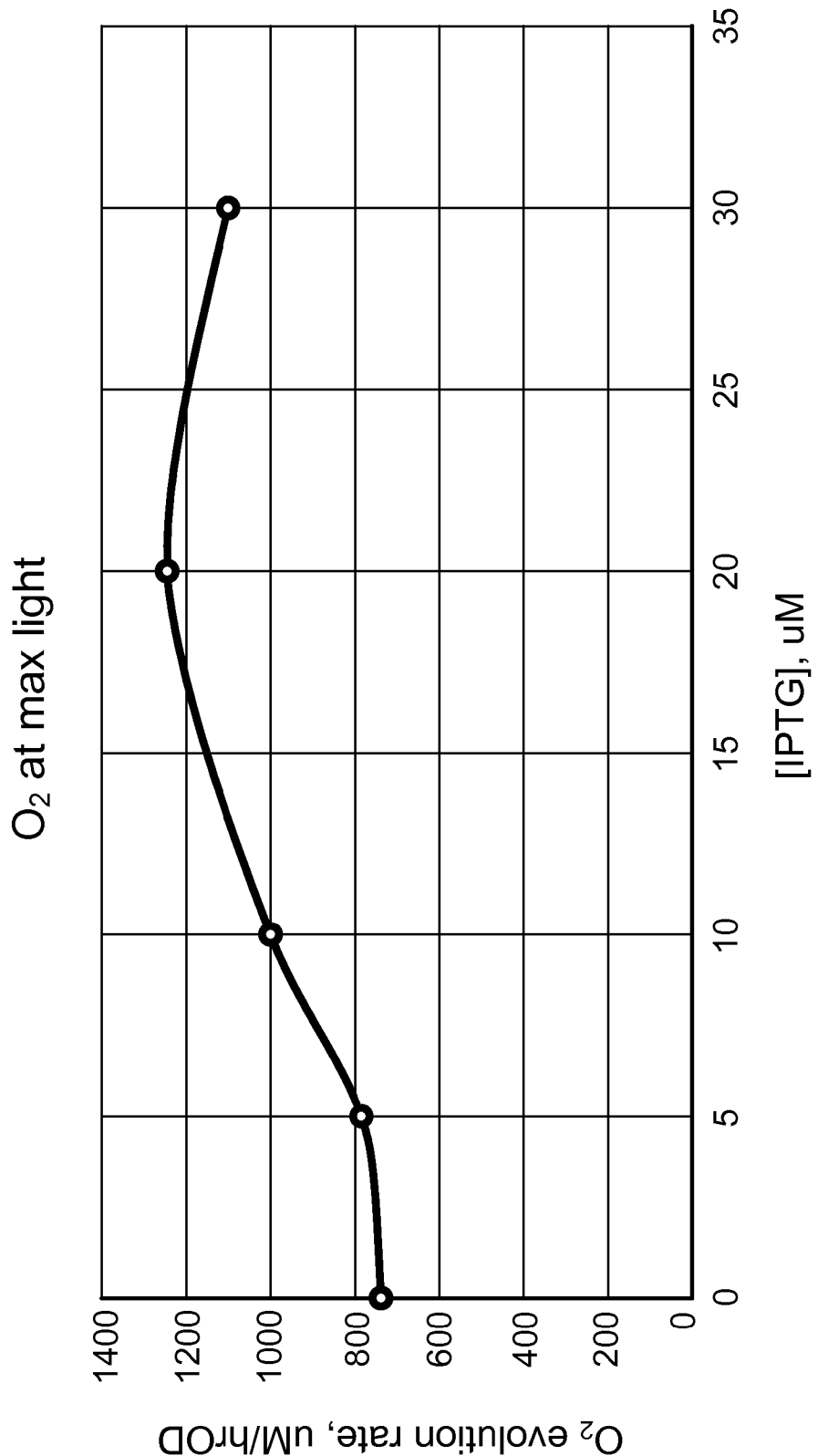
FIG. 19 shows a plot of the maximum light $O_2$ evolution for each culture of FIG. 18 at varying IPTG.

The experiment discussed above was repeated with NY056 [the markerless deletion of nblA strain (NY052) with nblA behind pTrc added to neutral site 4] in BG11+20 mM NaPi+0, 5, 10, 20, and 30 uM IPTG (singlet cultures). This time, a range of bilin decreases was seen as shown by the A800-normalized spectra of cultures grown for 30+ hrs in BG11+20 mM NaPi+0, 5, 10, 20, and 30 uM IPTG (See FIG. 17). In addition, 30 uM IPTG. 3 OD*mL worth of cells was also collected for SDS-PAGE analysis, which were flash frozen in 20 mM HEPES+10 mM EDTA+100 mM DTT+100 mM Na2CO3. After ~30 hours growth, $O_2$ evolution curves in the WALZ dual PAM 100 were observed for cells resuspended at ~2.0 OD750 in BG11+20 mM NaPi+10 mM NaHCO3. The curves are plotted and shown in FIG. 18. The maximum light $O_2$ evolution for each culture at varying IPTG was plotted as shown in FIG. 19.

Figure 20:
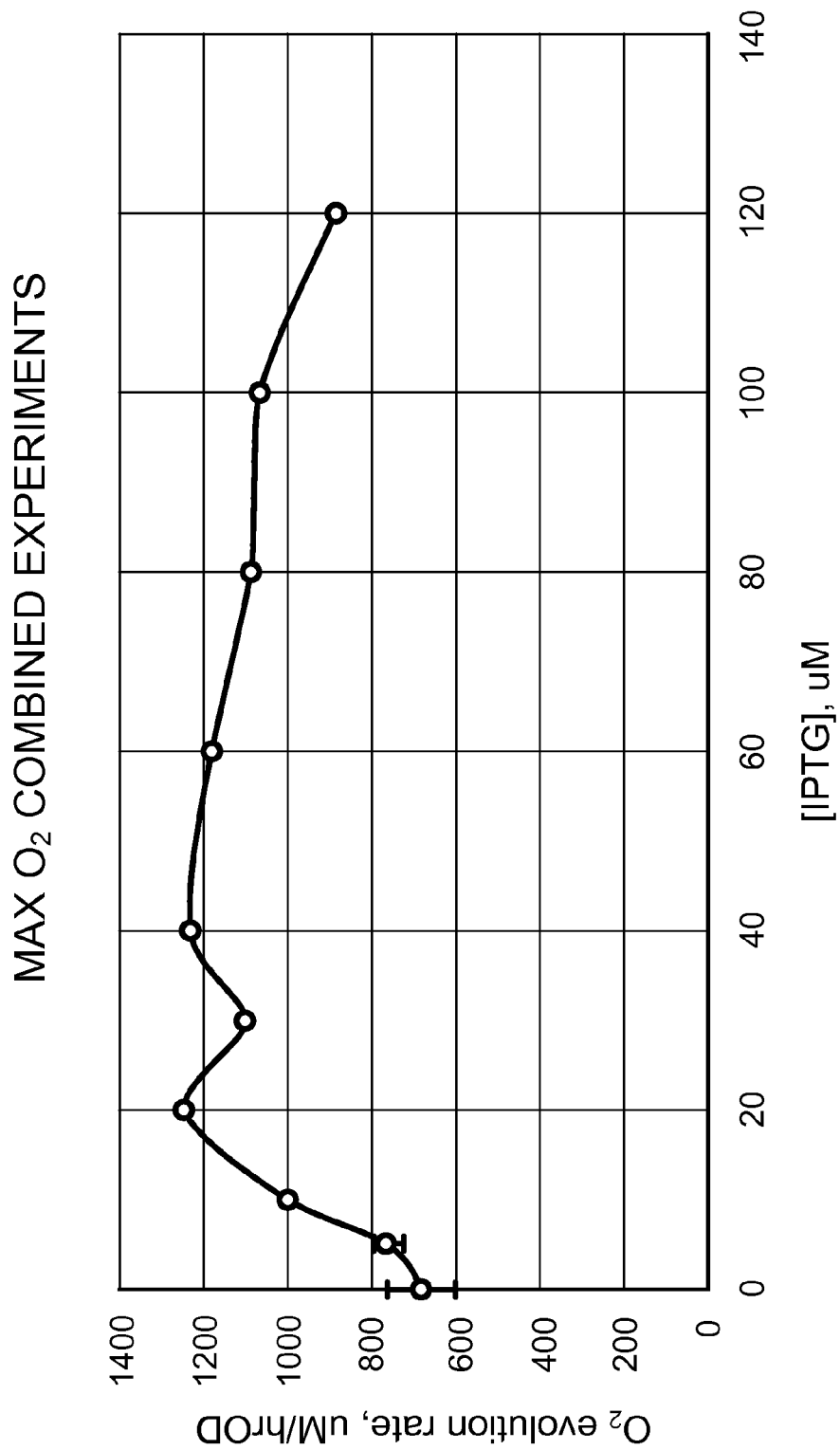
FIG. 20 shows the maximum light $O_2$ for both experiments (FIGS. 13 and 17) combined in one maximum light $O_2$ graph.

FIG. 20 shows the maximum light $O_2$ for both experiments combined in one maximum light $O_2$ graph. FIG. 20 shows that the improvement in oxygen production (photosynthetic activity) varies as a function of the amount of NblA expressed (ie the amount of IPTG inducer). An optimum improvement is observed at about 20 micromolar IPTG. This corresponds to an approximately 40% decrease in light harvesting protein.

SEQUENCE LISTING (245 sequences)

SEQ ID NO: 1 - DNA, 1026 bp, Synechococcus elongatus
atgttcggtcttatcggtcatctcaccagtttggagcaggcccgcgacgtttctcgcaggatgggctacgacgaatacgccgatcaaggattggagttttggagtagcgctcctcctcaaatcgttgatgaaatcacagtcaccagtgccacaggcaaggtgattcacggtcgctacatcgaatcgtgtttcttgccggaaatgctggcggcgcgccgcttcaaaacagccacgcgcaaagttctcaatgccatgtcccatgcccaaaaacacggcatcgacatctcggccttggggggctttacctcgattattttcgagaatttcgatttggccagtttgcggcaagtgcgcgacactaccttggagtttgaacggttcaccaccggcaatactcacacggcctacgtaatctgtagacaggtggaagccgctgctaaaacgctgggcatcgacattacccaagcgacagtagcggttgtcggcgcgactggcgatatcggtagcgctgtctgccgctggctcgacctcaaactgggtgtcggtgatttgatcctgacggcgcgcaatcaggagcgtttggataacctgcaggctgaactcggccggggcaagattctgcccttggaagccgctctgccggaagctgactttatcgtgtgggtcgccagtatgcctcagggcgtagtgatcgacccagcaaccctgaagcaaccctgcgtcctaatcgacgggggctaccccaaaaacttgggcagcaaagtccaaggtgagggcatctatgtcctcaatggcggggtagttgaacattgcttcgacatcgactggcagatcatgtccgctgcagagatggcgcggcccgagcgccagatgtttgcctgctttgccgaggcgatgctcttggaatttgaaggctggcatactaacttctcctggggccgcaaccaaatcacgatcgagaagatggaagcgatcggtgaggcatcggtgcgccacggcttccaacccttggcattggcaatttga

SEQ ID NO: 2 - protein, 341 aa, Synechococcus elongatus
MFGLIGHLTSLEQARDVSRRMGYDEYADQGLEFWSSAPPQIVDEITVTSATGKVIHGRYIESCFLPEMLAARRFKTATRKVLNAMSHAQKHGIDISALGGFTSIIFENFDLASLRQVRDTTLEFERFTTGNTHTAYVICRQVEAAAKTLGIDITQATVAVVGATGDIGSAVCRWLDLKLGVGDLILTARNQERLDNLQAELGRGKILPLEAALPEADFIVWVASMPQGVVIDPATLKQPCVLIDGGYPKNLGSKVQGEGIYVLNGGVVEHCFDIDWQIMSAAEMARPERQMFACFAEAMLLEFEGWHTNFSWGRNQITIEKMEAIGEASVRHGFQPLALAI

SEQ ID NO: 3 - DNA, 1023 bp, Synechocystis sp.
atgtttggtcttattggtcatctcacgagtttagaacacgcccaagcggttgctgaagatttaggctatcctgagtacgccaaccaaggcctggatttttggtgttcggctcctccccaagtggttgataattttcaggtgaaaagtgtgacggggcaggtgattgaaggcaaatatgtggagtcttgctttttgccggaaatgttaacccaacggcggatcaaagcggccattcgtaaaatcctcaatgctatggccctggcccaaaaggtgggcttggatattacggccctgggaggcttttcttcaatcgtatttgaagaatttaacctcaagcaaaataatcaagtccgcaatgtggaactagattttcagcggttcaccactggtaatacccacaccgcttatgtgatctgccgtcaggtcgagtctggagctaaacagttgggtattgatctaagtcaggcaacggtagcggtttgtggcgccacgggagatattggtagcgccgtatgtcgttggttagatagcaaacatcaagttaaggaattattgctaattgcccgtaaccgccaaagattggaaaatctccaagaggaattgggtcggggcaaaattatggatttggaaacagccctgccccaggcagatattattgtttgggtggctagtatgcccaagggggtagaaattgcgggggaaatgctgaaaaagccctgtttgattgtggatgggggctatcccaagaatttagacaccagggtgaaagcggatggggtgcatattctcaagggggggattgtagaacattcccttgatattacctgggaaattatgaagattgtggagatggatattccctcccggcaaatgttcgcctgttttgcggaggccattttgctagagtttgagggctggcgcactaatttttcctggggccgcaaccaaatttccgttaataaaatggaggcgattggtgaagcttctgtcaagcatggcttttgccctttagtagctctttag

SEQ ID NO: 4 - protein, 340 aa, Synechocystis sp.
MFGLIGHLTSLEHAQAVAEDLGYPEYANQGLDFWCSAPPQVVDNFQVKSVTGQVIEGKYVESCFLPEMLTQRRIKAAIRKILNAMALAQKVGLDITALGGFSSIVFEEFNLKQNNQVRNVELDFQRFTTGNTHTAYVICRQVESGAKQLGIDLSQATVAVCGATGDIGSAVCRWLDSKHQVKELLLIARNRQRLENLQEELGRGKIMDLETALPQADIIVWVASMPKGVEIAGEMLKKPCLIVDGGYPKNLDTRVKADGVHILKGGIVEHSLDITWEIMKIVEMDIPSRQMFACFAEAILLEFEGWRTNFSWGRNQISVNKMEAIGEASVKHGFCPLVAL

SEQ ID NO: 5 - DNA, 243 bp, Synechococcus elongatus PCC 7942
atgagccaagaagacatcttcagcaaagtcaaagacattgtggctgagcagctgagtgtggatgtggctgaagtcaagccagaatccagcttccaaaacgatctgggagcggactcgctggacaccgtggaactggtgatggctctggaagaggctttcgatatcgaaatccccgatgaagccgctgaaggcattgcgaccgttcaagacgccgtcgatttcatcgctagcaaagctgcctag

SEQ ID NO: 6 - protein, 80 aa, Synechococcus elongatus PCC 7942
MSQEDIFSKVKDIVAEQLSVDVAEVKPESSFQNDLGADSLDTVELVMALEEAFDIEIPDEAAEGIATVQDAVDFIASKAA

SEQ ID NO: 7 - DNA, 261 bp, Acinetobacter sp. ADP1
atgtcgaacctggcggatgagatcaaacaaatgatcattgacgtcctcgctctcgaggatatccaaatccaggatattgatgaaacggcaccgctgttcggggatggtttgggcctggatagtattgacgcgctcgaactcggcctggccttgaaaaagcgctaccacatccatttgaatgccgaatctgacgaaactaagcagcactttcggtccattcagagcctggtgaccctggtggaggcccaacagaaagcttag

SEQ ID NO: 8 - protein, 86 aa, Acinetobacter sp. ADP1
MSNLADEIKQMIIDVLALEDIQIQDIDETAPLFGDGLGLDSIDALELGLALKKRYHIHLNAESDETKQHFRSIQSLVTLVEAQQKA

SEQ ID NO: 9 - DNA, 246 bp, Acinetobacter sp. ADP1
atgttgagtcaggaacacatcctctccacactccgcgaatggatggaggacttgtttgaaatcgagcctgaaaccattcaactggattctaacctgtactcggacctggatgtggatagcattgatgcggtcgatctgattgtcaagatcaaagagctcacgggcaaacaggtgaaaccggaagacttcaagaatgtccggactgtccatgatgttgtgaccgtgatccaaaacatgacggcttag

SEQ ID NO: 10 - protein, 81 aa, Acinetobacter sp. ADP1
MLSQEHILSTLREWMEDLFEIEPETIQLDSNLYSDLDVDSIDAVDLIVKIKELTGKQVKPEDFKNVRTVHDVVTVIQNMTA

SEQ ID NO: 11 - DNA, 345 bp, Acinetobacter sp. ADP1
atggtcgtctacacgtggccgaaatgtcgttgcattaactttcagaaaatccaatacagcatcaaactgacagcgatcaaaacgcctcgagcaatgcgccgcattcccgtgtctgatattgaacaacgggtgaagcaggccgtggcagaacagctcggcatcaaagccgaagaaatcaagaatgaggcttcgttcatggatgacttgggtgccgacagtctggatctcgtcgagctggtgatgagctttgagaatgattttgatatcaccattccggatgaagactcgaacgagatcactaccgttcaatccgcgattgactacgtgaccaagaagctgggttag

SEQ ID NO: 12 - protein, 114 aa, Acinetobacter sp. ADP1
MVVYTWPKCRCINFQKIQYSIKLTAIKTPRAMRRIPVSDIEQRVKQAVAEQLGIKAEEIKNEASFMDDLGADSLDLVELVMSFENDFDITIPDEDSNEITTVQSAIDYVTKKLG

SEQ ID NO: 13 - DNA, 246 bp, Spinacia oleracea
gcaaagaaggaaacaattgacaaagtgtgcgacattgtaaaggagaaactggctttaggagctgatgttgtggtcacagctgattccgagtttagtaaactcggtgctgattcattggacacggttgagatagtgatgaacctcgaggaagagttcggtatcaatgtggatgaagataaagctcaagatatatcaaccatccaacaagccgccgacgttattgagagtcttcttgagaagaaatag

SEQ ID NO: 14 - protein, 81 aa, Spinacia oleracea
AKKETIDKVCDIVKEKLALGADVVVTADSEFSKLGADSLDTVEIVMNLEEEFGINVDEDKAQDISTIQQAADVIESLLEKK

SEQ ID NO: 15 - protein, 7 aa, Artificial Sequence
  Heptapeptide retention motif
  VARIANT (3)..(3): Xaa = Any Amino Acid
FYXDWWN

SEQ ID NO: 16 - DNA, 1752 bp, Escherichia coli
atgttaacggcatgtatatcatttggggttgcgatgacgacgaacacgcattttagaggtgaagaattgaaaaaagtgtggctcaatcggtatccggcggatgtcccaactgaaatcaaccctgatcgatatcagtccctcgtggacatgtttgaacagagcgtggcacgctacgccgatcagcccgccttcgtgaatatgggcgaggttatgacgtttcggaaattggaagaacgctctcgggcgtttgcggcttatttgcagcagggcctgggcctgaagaaaggtgatcgggtcgccttgatgatgcccaacctcttgcaatacccggtcgccctgtttggaatcctgcgtgctggcatgattgtcgtgaatgtgaatcctctctacacccctcgtgaactcgaacaccagctgaacgatagtggcgcttccgctattgttatcgtgtctaatttcgctcatacgctggagaaggtcgtggacaagacagccgttcaacacgtcattctgacccgcatgggtgatcaactgagtacggcaaaaggtacggtcgtcaattttgtcgtcaaatatatcaaacgtctggtccccaagtaccatctgccagacgcgatttccttccggagtgctttgcataacggatatcgaatgcaatacgtgaaacccgaactggtgcctgaggacctcgcatttctgcagtacacaggtggcaccaccggggtggccaagggtgctatgctgacacatcgaaatatgctcgccaacctcgagcaggtcaacgccacctacggtccgctgttgcacccaggcaaggagctggttgtgacggctttgcccctgtatcatatttttgctctgacgatcaactgcctgctgtttattgagttgggtggtcagaacctcctgatcaccaatccacgcgatattccgggcctcgttaaagaactcgcgaaatacccctttactgcgatcacgggtgttaatactctctttaacgcgctgctcaacaataaggagttccaacagttggacttcagcagcctgcatctctctgccggcggtggcatgcctgtgcaacaagttgttgcggagcgatgggtgaaattgacggggcagtatctgttggaggggtacgggttgaccgaatgcgcacctctggtgtcggtgaacccctacgatattgactaccacagcggatcgatcggcctgccggtgccgtcgacagaagcgaaactggttgacgacgatgataacgaggtgcccccaggccaaccgggggagttgtgtgttaagggaccgcaagtcatgctcgggtactggcagcggccggatgccactgatgaaattatcaagaatggttggctccacaccggggacattgcagttatggatgaagagggattcctgcgcatcgtcgatcgcaaaaaagacatgatcctcgtgtccggctttaatgtctatccaaatgaaatcgaggatgtcgttatgcagcaccctggggtgcaggaggttgccgctgttggcgtgcctagcgggagtagcggcgaagcggtcaaaattttcgttgtcaagaaggaccccagtttgaccgaagagtcgttggtcacgttctgtcgccgccaactgactggatataaagtccccaaactcgtcgaatttcgggatgaattgcccaagtcgaacgtcggcaagatcctccgccgcgagttgcgcgatgaagcacgcggtaaggttgacaataaggcttag

SEQ ID NO: 17 - protein, 583 aa, Escherichia coli
MLTACISFGVAMTTNTHFRGEELKKVWLNRYPADVPTEINPDRYQSLVDMFEQSVARYADQPAFVNMGEVMTFRKLEERSRAFAAYLQQGLGLKKGDRVALMMPNLLQYPVALFGILRAGMIVVNVNPLYTPRELEHQLNDSGASAIVIVSNFAHTLEKVVDKTAVQHVILTRMGDQLSTAKGTVVNFVVKYIKRLVPKYHLPDAISFRSALHNGYRMQYVKPELVPEDLAFLQYTGGTTGVAKGAMLTHRNMLANLEQVNATYGPLLHPGKELVVTALPLYHIFALTINCLLFIELGGQNLLITNPRDIPGLVKELAKYPFTAITGVNTLFNALLNNKEFQQLDFSSLHLSAGGGMPVQQVVAERWVKLTGQYLLEGYGLTECAPLVSVNPYDIDYHSGSIGLPVPSTEAKLVDDDDNEVPPGQPGELCVKGPQVMLGYWQRPDATDEIIKNGWLHTGDIAVMDEEGFLRIVDRKKDMILVSGFNVYPNEIEDVVMQHPGVQEVAAVGVPSGSSGEAVKIFVVKKDPSLTEESLVTFCRRQLTGYKVPKLVEFRDELPKSNVGKILRRELRDEARGKVDNKA

SEQ ID NO: 18 - DNA, 2103 bp, Saccharomyces cerevisiae S288c
atggttgctcaatataccgttccagttgggaaagccgccaatgagcatgaaactgctccaagaagaaattatcaatgccgcgagaagccgctcgtcagaccgcctaacacaaagtgttccactgtttatgagtttgttctagagtgctttcagaagaacaaaaattcaaatgctatgggttggagggatgttaaggaaattcatgaagaatccaaatcggttatgaaaaaagttgatggcaaggagacttcagtggaaaagaaatggatgtattatgaactatcgcattatcattataattcatttgaccaattgaccgatatcatgcatgaaattggtcgtgggttggtgaaaataggattaaagcctaatgatgatgacaaattacatctttacgcagccacttctcacaagtggatgaagatgttcttaggagcgcagtctcaaggtattcctgtcgtcactgcctacgatactttgggagagaaagggctaattcattctttggtgcaaacggggtctaaggccatttttaccgataactctttattaccatccttgatcaaaccagtgcaagccgctcaagacgtaaaatacataattcatttcgattccatcagttctgaggacaggaggcaaagtggtaagatctatcaatctgctcatgatgccatcaacagaattaaagaagttagacctgatatcaagacctttagctttgacgacatcttgaagctaggtaaagaatcctgtaacgaaatcgatgttcatccacctggcaaggatgatctttgttgcatcatgtatacgtctggttctacaggtgagccaaagggtgttgtcttgaaacattcaaatgttgtcgcaggtgttggtggtgcaagtttgaatgttttgaagtttgtgggcaataccgaccgtgttatctgttttttgccactagctcatatttttgaattggttttcgaactattgtccttttattggggggcctgcattggttatgccaccgtaaaaactttaactagcagctctgtgagaaattgtcaaggtgatttgcaagaattcaagcccacaatcatggttggtgtcgccgctgtttgggaaacagtgagaaaagggatcttaaaccaaattgataatttgcccttcctcaccaagaaaatcttctggaccgcgtataataccaagttgaacatgcaacgtctccacatccctggtggcggcgccttaggaaacttggttttcaaaaaaatcagaactgccacaggtggccaattaagatatttgttaaacggtggttctccaatcagtcgggatgctcaggaattcatcacaaatttaatctgccctatgcttattggttacggtttaaccgagacatgcgctagtaccaccatcttggatcctgctaattttgaactcggcgtcgctggtgacctaacaggttgtgttaccgtcaaactagttgatgttgaagaattaggttattttgctaaaaacaaccaaggtgaagtttggatcacaggtgccaatgtcacgcctgaatattataagaatgaggaagaaacttctcaagctttaacaagcgatggttggttcaagaccggtgacatcggtgaatgggaagcaaatggccatttgaaaataattgacaggaagaaaaacttggtcaaaacaatgaacggtgaatatatcgcactcgagaaattagagtccgtttacagatctaacgaatatgttgctaacatttgtgtttatgccgaccaatctaagactaagccagttggtattattgtaccaaatcatgctccattaacgaagcttgctaaaaagttgggaattatggaacaaaaagacagttcaattaatatcgaaaattatttggaggatgcaaaattgattaaagctgtttattctgatcttttgaagacaggtaaagaccaaggtttggttggcattgaattactagcaggcatagtgttctttgacggcgaatggactccacaaaacggttttgttacgtccgctcagaaattgaaaagaaaagacattttgaatgctgtcaaagataaagttgacgccgtttatagttcgtcttaa

SEQ ID NO: 19 - protein, 700 aa, Saccharomyces cerevisiae S288c
MVAQYTVPVGKAANEHETAPRRNYQCREKPLVRPPNTKCSTVYEFVLECFQKNKNSNAMGWRDVKEIHEESKSVMKKVDGKETSVEKKWMYYELSHYHYNSFDQLTDIMHEIGRGLVKIGLKPNDDDKLHLYAATSHKWMKMFLGAQSQGIPVVTAYDTLGEKGLIHSLVQTGSKAIFTDNSLLPSLIKPVQAAQDVKYIIHFDSISSEDRRQSGKIYQSAHDAINRIKEVRPDIKTFSFDDILKLGKESCNEIDVHPPGKDDLCCIMYTSGSTGEPKGVVLKHSNVVAGVGGASLNVLKFVGNTDRVICFLPLAHIFELVFELLSFYWGACIGYATVKTLTSSSVRNCQGDLQEFKPTIMVGVAAVWETVRKGILNQIDNLPFLTKKIFWTAYNTKLNMQRLHIPGGGALGNLVFKKIRTATGGQLRYLLNGGSPISRDAQEFITNLICPMLIGYGLTETCASTTILDPANFELGVAGDLTGCVTVKLVDVEELGYFAKNNQGEVWITGANVTPEYYKNEEETSQALTSDGWFKTGDIGEWEANGHLKIIDRKKNLVKTMNGEYIALEKLESVYRSNEYVANICVYADQSKTKPVGIIVPNHAPLTKLAKKLGIMEQKDSSINIENYLEDAKLIKAVYSDLLKTGKDQGLVGIELLAGIVFFDGEWTPQNGFVTSAQKLKRKDILNAVKDKVDAVYSSS

SEQ ID NO: 20 - DNA, 2235 bp, Saccharomyces cerevisiae S288c
atggccgctccagattatgcacttaccgatttaattgaatcggatcctcgtttcgaaagtttgaagacaagattagccggttacaccaaaggctctgatgaatatattgaagagctatactctcaattaccactgaccagctatcccaggtacaaaacatttttaaagaaacaggcggttgccatttcgaatccggataatgaagctggttttagctcgatttataggagttctctttcttctgaaaatctagtgagctgtgtggataaaaacttaagaactgcatacgatcacttcatgttttctgcaaggagatggcctcaacgtgactgtttaggttcaaggccaattgataaagccacaggcacctgggaggaaacattccgtttcgagtcgtactccacggtatctaaaagatgtcataatatcggaagtggtatattgtctttggtaaacacgaaaaggaaacgtcctttggaagccaatgattttgttgttgctatcttatcacacaacaaccctgaatggatcctaacagatttggcctgtcaggcctattctctaactaacacggctttgtacgaaacattaggtccaaacacctccgagtacatattgaatttaaccgaggcccccattctgatttttgcaaaatcaaatatgtatcatgtattgaagatggtgcctgatatgaaatttgttaatactttggtttgtatggatgaattaactcatgacgagctccgtatgctaaatgaatcgttgctacccgttaagtgcaactctctcaatgaaaaaatcacatttttttcattggagcaggtagaacaagttggttgctttaacaaaattcctgcaattccacctaccccagattccttgtatactatttcgtttacttctggtactacaggtttacctaaaggtgtggaaatgtctcacagaaacattgcgtctgggatagcatttgctttttctaccttcagaataccgccagataaaagaaaccaacagttatatgatatgtgttttttgccattggctcatatttttgaaagaatggttattgcgtatgatctagccatcgggtttggaataggcttcttacataaaccagacccaactgtattggtagaggatttgaagattttgaaaccttacgcggttgccctggttcctagaatattaacacggtttgaagccggtataaaaaacgctttggataaatcgactgtccagaggaacgtagcaaatactatattggattctaaatcggccagatttaccgcaagaggtggtccagataaatcgattatgaattttctagtttatcatcgcgtattgattgataaaatcagagactctttaggtttgtccaataactcgtttataattaccggatcagctcccatatctaaagataccttactatttttaagaagtgccttggatattggtataagacagggctacggcttaactgaaacttttgctggtgtctgtttaagcgaaccgtttgaaaaagatgtcggatcttgtggtgccataggtatttctgcagaatgtagattgaagtctgttccagaaatgggttaccatgccgacaaggatttaaaaggtgaactgcaaattcgtggcccacaggtttttgaaagatattttaaaaatccgaatgaaacttcaaaagccgttgaccaagatggttggttttccacgggagatgttgcatttatcgatggaaaaggtcgcatcagcgtcattgatcgagtcaagaactttttcaagctagcacatggtgaatatattgctccagagaaaatcgaaaatatttatttatcatcatgcccctatatcacgcaaatatttgtctttggagatcctttaaagacatttttagttggcatcgttggtgttgatgttgatgcagcgcaaccgattttagctgcaaagcacccagaggtgaaaacgtggactaaggaagtgctagtagaaaacttaaatcgtaataaaaagctaaggaaggaatttttaaacaaaattaataaatgcaccgatgggctacaaggattcgaaaaattgcataacatcaaagtcggacttgagcctttaactctcgaggatgatgttgtgacgccaacttttaaaataaagcgtgccaaagcatcaaaattcttcaaagatacattagaccaactatacgccgaaggttcactagtcaagacagaaaagctttag

SEQ ID NO: 21 - protein, 744 aa, Saccharomyces cerevisiae S288c
MAAPDYALTDLIESDPRFESLKTRLAGYTKGSDEYIEELYSQLPLTSYPRYKTFLKKQAVAISNPDNEAGFSSIYRSSLSSENLVSCVDKNLRTAYDHFMFSARRWPQRDCLGSRPIDKATGTWEETFRFESYSTVSKRCHNIGSGILSLVNTKRKRPLEANDFVVAILSHNNPEWILTDLACQAYSLTNTALYETLGPNTSEYILNLTEAPILIFAKSNMYHVLKMVPDMKFVNTLVCMDELTHDELRMLNESLLPVKCNSLNEKITFFSLEQVEQVGCFNKIPAIPPTPDSLYTISFTSGTTGLPKGVEMSHRNIASGIAFAFSTFRIPPDKRNQQLYDMCFLPLAHIFERMVIAYDLAIGFGIGFLHKPDPTVLVEDLKILKPYAVALVPRILTRFEAGIKNALDKSTVQRNVANTILDSKSARFTARGGPDKSIMNFLVYHRVLIDKIRDSLGLSNNSFIITGSAPISKDTLLFLRSALDIGIRQGYGLTETFAGVCLSEPFEKDVGSCGAIGISAECRLKSVPEMGYHADKDLKGELQIRGPQVFERYFKNPNETSKAVDQDGWFSTGDVAFIDGKGRISVIDRVKNFFKLAHGEYIAPEKIENIYLSSCPYITQIFVFGDPLKTFLVGIVGVDVDAAQPILAAKHPEVKTWTKEVLVENLNRNKKLRKEFLNKINKCTDGLQGFEKLHNIKVGLEPLTLEDDVVTPTFKIKRAKASKFFKDTLDQLYAEGSLVKTEKL

SEQ ID NO: 22 - DNA, 2081 bp, Artificial Sequence
  S. cerevisiae FadD homolog (Faa3p)  - codon optimized
atgtctgaacaacactcggtggccgtcggtaaagccgctaacgaacatgaaactgccccccgacgtaacgtgcgcgtgaaaaaacgccccttgattcgccctctcaatagcagcgcgtcgacgttgtatgagtttgccctggaatgctttaacaaggggggcaaacgcgatggcatggcgtggcgagacgtcatcgagattcacgaaacgaagaagactatcgtgcgtaaggtcgacggaaaggataaaagcattgaaaagacctggctgtactacgaaatgagcccgtacaaaatgatgacgtatcaggaactcatttgggtgatgcatgatatgggtcgcgggctcgccaagattggcatcaagcccaacggtgaacacaaatttcatattttcgcgtcgacctcccacaaatggatgaaaatctttctcggctgcatctcgcaaggcattcctgtggtcaccgcttatgataccctcggcgaaagtggtctcattcattctatggtggaaacagagagtgctgctatctttacagataaccaattgctggcgaaaatgatcgtgcctctgcagtctgctaaagatatcaagtttctcattcacaacgagccaatcgaccccaatgatcgacgccagaatggaaaactctataaagctgctaaggacgcgatcaacaagattcgcgaggttcggcctgatatcaagatttactcgttcgaagaagtggttaaaatcggcaagaagagtaaagatgaagtgaaactgcatccgcccgaacccaaggatctcgcgtgtatcatgtacaccagtggatctatcagcgcgcccaaaggggtggtcctgacccattataatatcgtcagtgggattgcaggcgttgggcataacgtctttggctggatcggctccaccgatcgtgtcctgagctttttgcctctcgcacacattttcgaactcgtttttgaattcgaagcgttctactggaatggtattctgggatacggcagcgtgaaaaccttgacgaatacgagcacccgcaactgtaaaggtgatctggtggagtttaaaccgaccatcatgattggtgttgcggccgtttgggagacggtccgcaaagcgatcctggagaaaatcagtgatttgacaccggtgctgcagaagattttctggtcggcttacagcatgaaagagaaaagtgtgccatgcacgggatttttgtctcgtatggtctttaaaaaggttcgacaagctaccggtggtcacctcaagtatattatgaatggcggctccgctatctctattgacgcccaaaaattctttagtatcgtcttgtgcccgatgatcattggttatggcttgactgaaacagtggcaaacgcctgtgttctcgagccggaccattttgagtatggcatcgttggggacctggtggggtcggtcacggcaaaattggttgacgtgaaggatctggggtactatgccaaaaataatcagggggaactcctgttgaagggagcgcccgtctgcagcgaatactacaagaatccgattgagacagctgtgagcttcacatacgacggttggtttcgtaccggcgatatcgtcgagtggacgccaaagggtcagctcaaaattattgatcggcgcaagaacctggtcaagactttgaatggcgagtatattgcgctggaaaagctggagagcgtttaccgctcgaacagttacgtcaagaatatctgtgtgtacgccgatgagtcccgagtgaaacccgttggtattgtggtcccaaaccctggaccgctgtctaagtttgctgtcaagctgcgcattatgaagaagggggaagacattgagaattatattcacgataaggcgctccggaacgcagtgttcaaagagatgatcgccactgcaaaatcgcagggcctggtcggcattgagctgttgtgtggtatcgttttcttcgacgaggaatggactcccgaaaatggcttcgtgactagcgcccaaaagttgaaacggcgcgagattttggcagccgtcaaatccgaggttgaacgcgtctataaagaaaatag

SEQ ID NO: 23 - protein, 694 aa, Saccharomyces cerevisiae S288c
MSEQHSVAVGKAANEHETAPRRNVRVKKRPLIRPLNSSASTLYEFALECFNKGGKRDGMAWRDVIEIHETKKTIVRKVDGKDKSIEKTWLYYEMSPYKMMTYQELIWVMHDMGRGLAKIGIKPNGEHKFHIFASTSHKWMKIFLGCISQGIPVVTAYDTLGESGLIHSMVETESAAIFTDNQLLAKMIVPLQSAKDIKFLIHNEPIDPNDRRQNGKLYKAAKDAINKIREVRPDIKIYSFEEVVKIGKKSKDEVKLHPPEPKDLACIMYTSGSISAPKGVVLTHYNIVSGIAGVGHNVFGWIGSTDRVLSFLPLAHIFELVFEFEAFYWNGILGYGSVKTLTNTSTRNCKGDLVEFKPTIMIGVAAVWETVRKAILEKISDLTPVLQKIFWSAYSMKEKSVPCTGFLSRMVFKKVRQATGGHLKYIMNGGSAISIDAQKFFSIVLCPMIIGYGLTETVANACVLEPDHFEYGIVGDLVGSVTAKLVDVKDLGYYAKNNQGELLLKGAPVCSEYYKNPIETAVSFTYDGWFRTGDIVEWTPKGQLKIIDRRKNLVKTLNGEYIALEKLESVYRSNSYVKNICVYADESRVKPVGIVVPNPGPLSKFAVKLRIMKKGEDIENYIHDKALRNAVFKEMIATAKSQGLVGIELLCGIVFFDEEWTPENGFVTSAQKLKRREILAAVKSEVERVYKENS

SEQ ID NO: 24 - DNA, 1632 bp, Synechococcus elongatus PCC 7942
atgaatatccacactgtcgcgacgcaagcctttagcgaccaaaagcccggtacctccggcctgcgcaagcaagttcctgtcttccaaaaacggcactatctcgaaaactttgtccagtcgatcttcgatagccttgagggttatcagggccagacgttagtgctggggggtgatggccgctactacaatcgcacagccatccaaaccattctgaaaatggcggcggccaatggttggggccgcgttttagttggacaaggcggtattctctccacgccagcagtctccaacctaatccgccagaacggagccttcggcggcatcatcctctcggctagccacaacccagggggccctgagggcgatttcggcatcaagtacaacatcagcaacggtggccctgcacccgaaaaagtcaccgatgccatctatgcctgcagcctcaaaattgaggcctaccgcattctcgaagccggtgacgttgacctcgatcgactcggtagtcaacaactgggcgagatgaccgttgaggtgatcgactcggtcgccgactacagccgcttgatgcaatccctgtttgacttcgatcgcattcgcgatcgcctgaggggggggctacggattgcgatcgactcgatgcatgccgtcaccggtccctacgccaccacgatttttgagaaggagctaggcgcggcggcaggcactgtttttaatggcaagccgctggaagactttggcgggggtcacccagacccgaatttggtctacgcccacgacttggttgaactgttgtttggcgatcgcgccccagattttggcgcggcctccgatggcgatggcgatcgcaacatgatcttgggcaatcacttttttgtgacccctagcgacagcttggcgattctcgcagccaatgccagcctagtgccggcctaccgcaatggactgtctgggattgcgcgatccatgcccaccagtgcggcggccgatcgcgtcgcccaagccctcaacctgccctgctacgaaaccccaacgggttggaagtttttcggcaatctgctcgatgccgatcgcgtcaccctctgcggcgaagaaagctttggcacaggctccaaccatgtgcgcgagaaggatggcctgtgggccgtgctgttctggctgaatattctggcggtgcgcgagcaatccgtggccgaaattgtccaagaacactggcgcacctacggccgcaactactactctcgccacgactacgaaggggtggagagcgatcgagccagtacgctggtggacaaactgcgatcgcagctacccagcctgaccggacagaaactgggagcctacaccgttgcctacgccgacgacttccgctacgaagatccggtcgatggcagcatcagcgaacagcagggcattcgtattggctttgaagacggctcacgtatggtcttccgcttgtctggtactggtacggcaggagccaccctgcgcctctacctcgagcgcttcgaaggggacaccaccaaacagggtctcgatccccaagttgccctggcagatttgattgcaatcgccgatgaagtcgcccagatcacaaccttgacgggcttcgatcaaccgacagtgatcacctga

SEQ ID NO: 25 - DNA, 1704 bp, Synechocystis sp. PCC 6803
gtgtctaagcccctgatcgccgccctccattttttacaatttttgtatatgacaagcagaattaatcccctcgccggccagcatccccccgccgacagccttttggatgtggccaaacttttagacgactattaccgtcagcaaccggacccggaaaatcccgcccagttagtgagctttggtacctctggccatcggggttctgccctcaacggtacttttaatgaagcccatattttggcggtgacccaggcagtggtggactatcgccaagcccagggcattacggggcccctttatatggggatggatagccatgctctgtcggaaccagcccagaaaacggcgttggaagtgttggccgctaaccaagtagaaacttttttaaccaccgccacggatttaacccgtttcacccccactccggcggtatcctacgccattttgacccacaaccagggacgtaaagaaggtttagcggacggcattattattaccccttcccacaatccccccactgatggaggctttaaatataatcccccctccggtggcccggcggaaccggaagcgacccaatggattcagaaccgggccaatgagttgctgaaaaatggcaataaaacagttaaacggctggattacgagcaggcattaaaagccaccaccacccatgcccatgattttgtcactccctatgtggccggtctggcggacatcattgacttggatgtaattcgttcagcgggcttgcgcttgggagttgaccccctggggggagccaatgtgggctattgggaacccattgccgctaaatacaatttgaacatcagcttggttaatcccggggtagatcccacgtttaaatttatgaccctggattgggacggcaaaatccgcatggattgttcttccccctacgccatggccagtttggtgaaaatcaaagaccattacgacattgcctttggcaacgacaccgacggcgatcgccatggcattgtcacccccagcgtgggtttgatgaatcccaatcattttctttccgtggccatttggtatttgtttagtcagcggcaacagtggtcagggctgtcggcgatcggcaaaaccctagtcagcagcagcatgattgaccgggtgggggccatgattaatcgccaagtttacgaagtgcccgtgggctttaaatggtttgtcagcggtttgctagatggttcctttggctttgggggtgaagaaagtgccggggcttcgtttttgaaaaaaaatggcaccgtttggaccaccgacaaagatggcaccattatggatttattggcggcggaaatcaccgctaaaaccggcaaagatcccggcctccattaccaggatttgaccgctaagttaggtaatcccatttaccaacgcattgatgcccccgccactccggcccaaaaagaccgcttgaaaaaactgtcccccgatgacgttacagctacctccttagctggggatgccattactgctaaattaaccaaagcccctggcaaccaagcggcgatcggtgggttgaaggtgaccactgcggaaggttggtttgcggcccggccctccggcacggaaaatgtttacaaaatctatgccgaaagtttcaaagacgaagcccatctccaggctattttcacggaggcggaagccattgttacctcggctttgggctaa

SEQ ID NO: 26 - DNA, 1659 bp, Synechococcus sp. WH8102
atgaccacctcggcccccgcggaaccgaccctgcgcctggtgcgcctggacgcacctttcacggatcagaaacccggcacatccggtttgcgcaaaagcagccagcagttcgagcaagcgaactatctggagagctttgtggaagccgtattccgcaccttgcccggtgttcaagggggcacgctggtgttgggaggtgacggccgttacggcaaccgccgtgccatcgacgtgatcctgcgcatgggcgcggcccacggcctcagcaaggtgatcgtcaccaccggcggcatcctctccaccccggcggcctcgaacctgattcgccagcgtcaggccatcggcggcatcatcctctcggcaagccacaaccctggcggccccaatggagacttcggcgtcaaggtgaatggcgccaacggtggcccgaccccggcctcgttcaccgatgcggtgttcgagtgcaccaagaccttggagcaatacacgatcgttgatgccgcggccatcgccatcgatacccccggcagctacagcatcggcgccatgcaggtggaggtgatcgacggcgtcgacgacttcgtggctctgatgcaacagctgttcgactttgatcggatccgggagctgatccgcagcgacttcccgctggcgtttgatgcgatgcatgcggtcactggcccctacgccactcgcctgttggaagagatcctcggcgctcctgccggcagcgtccgcaacggcgttcctctggaggacttcggcggcggccaccccgaccccaacctcacctacgcccacgagctggccgaacttctgctcgacggggaggagttccgcttcggggccgcctgcgacggcgatggtgaccgcaacatgatcctggggcagcactgcttcgtaaaccccagcgacagcctggcggtgctcacagccaacgccacggtggcaccggcctatgccgatggtttggctggcgtggcccgctcgatgcccaccagctctgccgtggatgtggtggccaaggaactgggcatcgactgctacgagacccccaccggctggaagttcttcggcaatctgctggatgccggcaaaatcacgctctgcggtgaagagagcttcggcaccggcagcaaccacgtgcgtgaaaaggatggcctctgggctgttctgttctggctgcagatcctggccgagcgccgctgcagcgtcgccgagatcatggctgagcattggaagcgcttcggccgccactactactctcgccacgactacgaagccgtcgccagcgacgcagcccatgggctgttccaccgcctcgagggcatgctccctggtctggtggggcagagcttcgctggccgcagcgtcagcgcagccgacaacttcagctacaccgatcccgttgatggctctgtgaccaagggccagggcctgcgcatcctgctggaggatggcagccgcgtgatggtgcgcctctcgggcaccggcaccaagggcgccacgatccgcgtctatctggagagttatgtaccgagcagcggtgatctcaaccaggatccccaggtcgctctggccgacatgatcagcgccatcaatgaactggcggagatcaagcagcgcaccggcatggatcggcccaccgtgatcacctga

SEQ ID NO: 27 - DNA, 1293 bp, Synechococcus elongatus PCC 7942
gtgaaaaacgtgctggcgatcattctcggtggaggcgcaggcagtcgtctctatccactaaccaaacagcgcgccaaaccagcggtccccctggcgggcaaataccgcttgatcgatattcccgtcagcaattgcatcaacgctgacatcaacaaaatctatgtgctgacgcagtttaactctgcctcgctcaaccgccacctcagtcagacctacaacctctccagcggctttggcaatggctttgttgaggtgctagcagctcagattacgccggagaaccccaactggttccaaggcaccgccgatgcggttcgccagtatctctggctaatcaaagagtgggatgtggatgagtacctgatcctgtcgggggatcatctctaccgcatggactatagccagttcattcagcggcaccgagacaccaatgccgacatcacactctcggtcttgccgatcgatgaaaagcgcgcctctgattttggcctgatgaagctagatggcagcggccgggtggtcgagttcagcgaaaagcccaaaggggatgaactcagggcgatgcaagtcgataccacgatcctcgggcttgaccctgtcgctgctgctgcccagcccttcattgcctcgatgggcatctacgtcttcaagcgggatgttctgatcgatttgctcagccatcatcccgagcaaaccgactttggcaaggaagtgattcccgctgcagccacccgctacaacacccaagcctttctgttcaacgactactgggaagacatcggcacgatcgcctcattctacgaggccaatctggcgctgactcagcaacctagcccacccttcagcttctacgacgagcaggcgccgatttacacccgcgctcgctacctgccgccaaccaagctgctcgattgccaggtgacccagtcgatcattggcgagggctgcattctcaagcaatgcaccgttcagaattccgtcttagggattcgctcccgcattgaggccgactgcgtgatccaggacgccttgttgatgggcgctgacttctacgaaacctcggagctacggcaccagaatcgggccaatggcaaagtgccgatgggaatcggcagtggcagcaccatccgtcgcgccatcgtcgacaaaaatgcccacattggccagaacgttcagatcgtcaacaaagaccatgtggaagaggccgatcgcgaagatctgggctttatgatccgcagcggcattgtcgttgtggtcaaaggggcggttattcccgacaacacggtgatctaa

SEQ ID NO: 28 - DNA, 1320 bp, Synechocystis sp. PCC 6803
gtgtgttgttggcaatcgagaggtctgcttgtgaaacgtgtcttagcgattatcctgggcggtggggccgggacccgcctctatcctttaaccaaactcagagccaaacccgcagttcccttggccggaaagtatcgcctcatcgatattcccgtcagtaattgcatcaactcagaaatcgttaaaatttacgtccttacccagtttaattccgcctcccttaaccgtcacatcagccgggcctataatttttccggcttccaagaaggatttgtggaagtcctcgccgcccaacaaaccaaagataatcctgattggtttcagggcactgctgatgcggtacggcaatacctctggttgtttagggaatgggacgtagatgaatatcttattctgtccggcgaccatctctaccgcatggattacgcccaatttgttaaaagacaccgggaaaccaatgccgacataaccctttccgttgtgcccgtggatgacagaaaggcacccgagctgggcttaatgaaaatcgacgcccagggcagaattactgacttttctgaaaagccccagggggaagccctccgggccatgcaggtggacaccagcgttttgggcctaagtgcggagaaggctaagcttaatccttacattgcctccatgggcatttacgttttcaagaaggaagtattgcacaacctcctggaaaaatatgaaggggcaacggactttggcaaagaaatcattcctgattcagccagtgatcacaatctgcaagcctatctctttgatgactattgggaagacattggtaccattgaagccttctatgaggctaatttagccctgaccaaacaacctagtcccgactttagtttttataacgaaaaagcccccatctataccaggggtcgttatcttccccccaccaaaatgttgaattccaccgtgacggaatccatgatcggggaaggttgcatgattaagcaatgtcgcatccaccactcagttttaggcattcgcagtcgcattgaatctgattgcaccattgaggatactttggtgatgggcaatgatttctacgaatcttcatcagaacgagacaccctcaaagcccggggggaaattgccgctggcataggttccggcaccactatccgccgagccatcatcgacaaaaatgcccgcatcggcaaaaacgtcatgattgtcaacaaggaaaatgtccaggaggctaaccgggaagagttaggtttttacatccgcaatggcatcgtagtagtgattaaaaatgtcacgatcgccgacggcacggtaatctag

SEQ ID NO: 29 - DNA, 1290 bp, Synechococcus sp. PCC 7002
gtgaaacgagtcctaggaatcatacttggcggcggcgcaggtactcgcctatatccgctaacaaaactcagagctaagcccgcagtacctctagcaggcaaatatcgtctcattgatattcctgttagcaattgcattaattctgaaattcataaaatctacattttaacccaatttaattcagcatctttaaatcgtcacattagtcgaacctacaactttaccggcttcaccgaaggctttaccgaagtactcgcagcccaacaaactaaagaaaatcccgattggttccaaggcaccgccgacgctgtccgacagtacagttggcttctagaagactgggatgtcgatgaatacatcattctctccggtgatcacctctaccgtatggattaccgtgaatttatccagcgccaccgtgacactggggcagacatcaccctgtctgtggttcccgtgggcgaaaaagtagcccccgcctttgggttgatgaaaattgatgccaatggtcgtgtcgtggactttagtgaaaagcccactggtgaagcccttaaggcgatgcaggtggatacccagtccttgggtctcgatccagagcaggcgaaagaaaagccctacattgcgtcgatggggatctacgtctttaagaaacaagtactcctcgatctactcaaagaaggcaaagataaaaccgatttcgggaaagaaattattcctgatgcggccaaggactacaacgttcaggcctatctctttgatgattattgggctgacattgggaccatcgaagcgttctatgaagcaaaccttggcttgacgaagcagccgatcccaccctttagtttctatgacgaaaaggctcccatctacacccgggcgcgctacttaccgccgacgaaggtgctcaacgctgacgtgacagaatcgatgatcagcgaaggttgcatcattaaaaactgccgcattcaccactcagttcttggcattcgcacccgtgtcgaagcggactgcactatcgaagatacgatgatcatgggcgcagattattatcagccctatgagaagcgccaggattgtctccgtcgtggcaagcctcccattgggattggtgaagggacaacgattcgccgggcgatcatcgataaaaatgcacgcatcggtaaaaacgtgatgatcgtcaataaggaaaatgtggaggagtcaaaccgtgaggagcttggctactacattcgcagcggcattacagtggtgctaaagaacgccgttattcccgacggtacggtcatttaa

SEQ ID NO: 30 - DNA, 1296 bp, Synechococcus sp. WH8102
atgaagcgggttttggccatcattctcggcggcggtgccgggactcgtctctacccgctcaccaagatgcgcgccaagccggccgtccccttggccggtaagtatcgactgattgatatccccatcagcaactgcatcaactcgaacatcaacaagatgtacgtgatgacgcagttcaacagtgcgtctctcaatcgtcacctcagccagacgttcaacctgagcgcatccttcggtcagggattcgtcgaggtgcttgctgcccagcagacgcctgacagtccatcctggtttgaaggcactgccgacgctgtgcggaagtaccagtggctgttccaggaatgggatgtcgatgaatacctgatcctgtccggtgaccagctgtaccggatggattacagcctgttcgttgaacatcaccgcagcactggtgctgacctcaccgttgcagcccttcctgtggacccgaaacaggccgaggcgttcggcttgatgcgcacggatggtgacggagacatcaaggagttccgcgaaaagcccaagggtgattctttgcttgagatggcggttgacaccagccgatttggactcagtgcgaattcggccaaggagcgtccctacctggcgtcgatggggatttatgtcttcagcagagacactctgttcgacctgctcgattccaatcctggttataaggacttcggcaaggaagtcattcctgaggccctcaagcgtggcgacaagctgaagagctatgtctttgacgattattgggaagatatcggaacgatcggagcgttctacgaggccaacctggcgctcacccagcaacccacaccccccttcagcttctacgacgagaagttcccgatctacactcgtccccgctatttacccccgagcaaactggttgatgctcagatcaccaattcgatcgttggcgaaggctcaattttgaagtcatgcagcattcatcactgcgttttgggtgttcgcagtcgcattgaaaccgatgtggtgctgcaagacaccttggtgatgggcgctgacttctttgaatccagtgatgagcgtgccgtgcttcgcgagcgtggtggtattccggtcggggtgggccaaggtacgactgtgaagcgcgccatcctcgataaaaacgctcgcatcggatccaacgtcaccatcgtcaacaaggatcacgtcgaggaagctgatcgttccgatcagggcttctatattcgtaatggcattgttgttgttgtcaagaacgccaccatccaggacggaactgtgatctga

SEQ ID NO: 31 - DNA, 1296 bp, Synechococcus sp. RCC 307
atgaaacgggttctcgcaatcattctcggtggcggtgcgggtacgcggctctatccgctgaccaaaatgcgggccaaaccagccgtgccgctggcgggtaagtaccgcctcatcgacatccccgttagcaactgcatcaacagcgggatcaacaagatctatgtgctgacgcagttcaacagcgcatcactgaatcgccacatcgctcaaaccttcaacctctcctcggggtttgatcaagggtttgttgaagttctggcggcccagcagaccccagatagccccagttggtttgaaggaacagccgatgctgttcgtaaatacgaatggctgctgcaggagtgggacatcgacgaagtgctgatcctttcgggtgaccagctctaccggatggactatgcccattttgtggctcagcaccgcgccagcggcgctgacctcaccgtggccgccctcccggttgatcgcgagcaagcccagagctttggcttgatgcacaccggtgcagaagcctccatcaccaagttccgcgaaaagcccaaaggcgaggcactcgatgagatgtcctgcgataccgccagcatgggcttgagcgctgaggaagcccatcgccggccgttcctggcttccatgggcatctacgtgttcaagcgggacgtgctcttccgcttactggctgaaaaccccggtgccactgacttcggtaaggagatcatccccaaggcactcgacgatggcttcaaactccgctcctatctcttcgacgattactgggaagacatcggaaccatccgtgctttctatgaagcgaatctggcgctgacgacccagccgcgtccgcccttctctttctacgacaagcgtttcccgatctacacacgtcatcgctacctgccgccctccaagcttcaagatgcgcaggtcaccgactccattgttggtgaggggtccattttgaaggcttgcagtattcaccactgcgtcttgggtgtgcgcagccgcattgaagacgaggttgccttgcaagacaccctggtgatgggcaacgacttctatgagtccggcgaagagcgggccatcctgcgggaacgtggtggcatccccatgggtgtgggccgaggaaccacggtgaaaaaggccatcctcgataagaacgtccgcatcggcagcaacgtcagcatcatcaacaaagacaacgttgaggaagccgaccgcgctgagcagggcttctacatccgtggcgggattgtggtgatcaccaaaaacgcttcgattcccgacgggatggtgatctga

SEQ ID NO: 32 - DNA, 1287 bp, Trichodesmium erythraeum IMS 101
gtgaaaaacgtactaagtataattctaggcggtggcgcaggtacccgtttatatcccttaacaaaactacgggccaagcctgcagtgcccctagcaggaaaatatcgtttaatagatattcctataagtaattgcataaactcagaaatccagaaaatttatgttttgacccaatttaactcagcttctctaaaccgccatatcactcgtacctataacttctcaggtttcagtgatggttttgtcgaagttctagcagctcaacaaactaaagataatccagagtggtttcaaggaacagcagatgctgtccgtaaatatatatggttattcaaagagtgggatattgattattatctaattctctctggagaccatctctaccgtatggactaccgagactttgtccaacgccatatcgacaccaaggcagatatcaccctttctgtcttgcctattgatgaagcacgggcctccgagtttggcgtcatgaaaattgataactcaggtcgaattgttgaatttagtgaaaaaccgaaaggtaatgcccttaaagctatggcagttgatacttctattttaggagtcagtccagaaatagctacaaaacaaccttatattgcttctatgggaatttatgtatttaataaagatgcaatgatcaaacttatagaagattcagaggatacagattttggtaaggaaattttacccaagtcggctcaatcttataatcttcaagcctacccattccaaggttactgggaagacatcggaaccatcaaatcattttatgaagctaatttggctttgactcaacagcctcagccaccctttagcttttatgatgaacaagcccctatctatacccgctctcgttatttacctccgagcaaacttttggactgtgagattacagagtcaattgtgggagaaggttgtattcttaaaaaatgtcggattgaccattgtgtcttaggagtgcgatcgcgtatagaagctaattgtataattcaagattctctgctaatgggttcagatttctatgaatctcctacagaacgtcgatatggcctaaaaaaaggttctgtacctttgggtattggtgctgaaacgaaaattcgtggagcaattattgacaaaaatgcccgcattggttgtaatgtccaaataatcaataaggacaatgtagaagaagcccaacgtgaggaggaagggtttatcattcgcagtggtattgttgttgttttgaaaaatgctactattcccgatggtacagtgatttag

SEQ ID NO: 33 - DNA, 1290 bp, Anabaena variabilis
gtgaaaaaagtcttagcaattattcttggtggtggtgcgggtactcgcctttacccactaaccaaactccgcgctaaaccggcagtaccagtggcagggaaataccgcctaatagatatccctgtcagtaactgcattaattcggaaatttttaaaatctacgtattaacacaatttaactcagcttctctcaatcgccacattgcccgtacctacaactttagtggttttagcgagggttttgtggaagtgctggccgcccagcagacaccagagaaccctaactggttccaaggtacagccgatgctgtacgtcagtatctctggatgttacaagagtgggacgtagatgaatttttgatcctgtcaggagatcacctgtaccggatggattatcgcctatttatccagcgccatcgagaaaccaatgcggatatcacactttccgtaattcccattgacgatcgccgcgcctcggattttggtttaatgaagatcgataactctggacgagtcatcgattttagcgaaaaacccaaaggcgaagccttaaccaaaatgcgtgttgataccaccgttttaggcttgacaccagaacaggcagcatcacagccttacatcgcctcgatggggatttacgtatttaaaaaagatgttttgatcaaactgttgaaggaatctttagaacgtactgatttcggcaaagaaattattcctgatgcctccaaagatcacaacgttcaagcttacttattcgatgactactgggaagatattgggacaatcgaagctttttataatgctaatttagcattgactcagcagcccatgccgccctttagcttctacgacgaagaagcaccaatttatacccgcgcacgttacttaccacccacaaaactattagattgccacgttacagaatcaatcattggcgaaggctgtattctgaaaaactgtcgcattcaacactcagtattgggagtgcgatcgcgtattgaaaccggctgcgtcatcgaagaatctttactcatgggtgccgacttctaccaagcttcagtggaacgccagtgcagcattgacaaaggagacatccccgtaggcatcggcccagataccattattcgccgtgccatcatcgataaaaatgcccgcatcggtcacgatgtcaaaattatcaataaagacaacgtgcaggaagccgaccgcgaaagtcaaggattttacatccgcagtggcattgtcgtcgttctcaaaaatgccgtcattaccgatggcacaataatttag

SEQ ID NO: 34 - DNA, 1290 bp, Nostoc sp. PCC 7120
gtgaaaaaagtcttagcaattattcttggtggtggtgcgggtactcgcctttacccactaaccaaactccgcgctaaaccggcagtaccagtggcagggaaataccgcctaatagatatccctgtcagtaactgcattaattcggaaatttttaaaatctacgtattaacacaatttaactcagcttctctcaatcgccacattgcccgtacctacaactttagtggttttagcgagggttttgtggaagtgctggccgcccagcagacaccagagaaccctaactggttccaaggtacagccgatgctgtacgtcagtatctctggatgttacaagagtgggacgtagatgaatttttgatcctgtcgggggatcacctgtaccggatggactatcgcctatttatccagcgccatcgagaaaccaatgcggatatcacactttccgtaattcccattgatgatcgccgcgcctcggattttggtttaatgaaaatcgataactctggacgagtcattgatttcagtgaaaaacccaagggcgaagccttaaccaaaatgcgtgttgataccacggttttaggcttgacaccagaacaggcggcatcacagccttacattgcctcgatggggatttacgtatttaaaaaagacgttttgatcaagctgttgaaggaagctttagaacgtactgatttcggcaaagaaattattcctgatgccgccaaagatcacaacgttcaagcttacctattcgatgactactgggaagatattgggacaatcgaagctttttataacgccaatttagcgttaactcagcagcccatgccgccctttagcttctacgatgaagaagcacctatttatacccgcgctcgttacttaccacccacaaaactattagattgccacgttacagaatcaatcattggcgaaggctgtattctgaaaaactgtcgcattcaacactcagtattgggagtgcgatcgcgtattgaaactggctgcatgatcgaagaatctttactcatgggtgccgacttctaccaagcttcagtggaacgccagtgcagcatcgataaaggagacatccctgtaggcatcggtccagatacaatcattcgccgtgccatcatcgataaaaatgcccgcatcggtcacgatgtcaaaattatcaataaagacaacgtgcaagaagccgaccgcgaaagtcaaggattttacatccgcagtggcattgtcgtcgtcctcaaaaatgccgttattacagatggcacaatcatttag

SEQ ID NO: 35 - DNA, 1398 bp, Synechococcus elongatus PCC 7942
atgcggattctgttcgtggctgccgaatgtgctcccttcgccaaagtgggaggcatgggagatgtggttggttccctgcccaaagtgctgaaagctctgggccatgatgtccgaatcttcatgccgtactacggctttctgaacagtaagctcgatattcccgctgaaccgatctggtggggctacgcgatgtttaatcacttcgcggtttacgaaacgcagctgcccggttcagatgtgccgctctacttaatggggcatccagcttttgatccgcatcgcatctactcaggagaagacgaagactggcgcttcacgttttttgccaatggggctgctgaattttcttggaactactggaaaccacaagtcattcactgccacgattggcacactgggatgattccggtttggatgcaccagtccccggatatctcgactgtcttcaccattcataacttggcctaccaagggccgtggcgctggaagctcgagaaaatcacctggtgcccttggtacatgcagggcgacagcaccatggcggcggccttgctctatgccgatcgcgtcaacacggtatcgcccacctatgcccagcagattcaaacaccgacctacggtgaaaagctggagggtcttctctcatttatcagtggcaagctaagcggcatccttaacgggattgatgttgatagctacaaccctgcaacggatacgcggattgtggccaactacgatcgcgacactcttgataaacgactgaacaataagctggcgctccaaaaggagatggggcttgaggtcaatcccgatcgcttcctgattggctttgtggctcgtctagtcgagcagaagggcattgacttgctgctgcaaattcttgatcgctttctgtcttacagcgatgcccaatttgttgtcttaggaacgggcgagcgctactacgaaacccagctctgggagttggcgacccgctatccgggccggatgtccacttatctgatgtacgacgaggggctgtcgcgacgcatttatgccggtagcgacgccttcttggtgccctctcgttttgaaccttgcggtatcacgcaaatgctggcactgcgctacggcagtgtgccgattgtgcgccgtacgggggggttggtcgatacggtcttccaccacgatccgcgtcatgccgagggcaatggctattgcttcgatcgctacgagccgctggacctctatacctgtctggtgcgggcttgggagagttaccagtaccagccccaatggcaaaagctacagcaacggggtatggccgttgatctgagctggaaacaatcggcgatcgcctacgaacagctctacgctgaagcgattgggctaccgatcgatgtcttacaggaggcctag

SEQ ID NO: 36 - DNA, 1434 bp, Synechocystis sp. PCC 6803
atgaagattttatttgtggcggcggaagtatcccccctagcaaaggtaggtggcatgggggatgtggtgggttccctgcctaaagttctgcatcagttgggccatgatgtccgtgtcttcatgccctactacggtttcatcggcgacaagattgatgtgcccaaggagccggtctggaaaggggaagccatgttccagcagtttgctgtttaccagtcctatctaccggacaccaaaattcctctctacttgttcggccatccagctttcgactcccgaaggatctatggcggagatgacgaggcgtggcggttcacttttttttctaacggggcagctgaatttgcctggaaccattggaagccggaaattatccattgccatgattggcacactggcatgatccctgtttggatgcatcagtccccagacatcgccaccgttttcaccatccataatcttgcttaccaagggccctggcggggcttgcttgaaactatgacttggtgtccttggtacatgcagggagacaatgtgatggcggcggcgattcaatttgccaatcgggtgactaccgtttctcccacctatgcccaacagatccaaaccccggcctatggggaaaagctggaagggttattgtcctacctgagtggtaatttagtcggtattctcaacggtattgatacggagatttacaacccggcggaagaccgctttatcagcaatgttttcgatgcggacagtttggacaagcgggtgaaaaataaaattgccatccaggaggaaacggggttagaaattaatcgtaatgccatggtggtgggtatagtggctcgcttggtggaacaaaaggggattgatttggtgattcagatccttgaccgcttcatgtcctacaccgattcccagttaattatcctcggcactggcgatcgccattacgaaacccaactttggcagatggcttcccgatttcctgggcggatggcggtgcaattactccacaacgatgccctttcccgtcgagtctatgccggggcggatgtgtttttaatgccttctcgctttgagccctgtgggctgagtcaattgatggccatgcgttatggctgtatccccattgtgcggcggacagggggtttggtggatacggtatccttctacgatcctatcaatgaagccggcaccggctattgctttgaccgttatgaacccctggattgctttacggccatggtgcgggcctgggagggtttccgtttcaaggcagattggcaaaaattacagcaacgggccatgcgggcagactttagttggtaccgttccgccggggaatatatcaaagtttataagggcgtggtggggaaaccggaggaattaagccccatggaagaggaaaaaatcgctgagttaactgcttcctatcgctaa

SEQ ID NO: 37 - DNA, 1437 bp, Synechococcus sp. PCC 7002
atgcgtattttgtttgtttctgccgaggctgctcccatcgctaaagctggaggcatgggagatgtggtgggatcactgcctaaagttttacggcagttaggacatgacgcgagaattttcttaccctattacggctttctcaacgacaaactcgacatccctgcagaacccgtttggtggggcagtgcgatgttcaatacttttgccgtttatgaaactgtgttgcccaacaccgatgtccccctttatctgtttggccatcccgcctttgatggacggcatatttatggtgggcaggatgaattttggcgctttaccttttttgccaatggggccgctgaatttatgtggaaccactggaaaccccagatcgcccactgtcacgactggcacacgggcatgattccggtatggatgcaccaatcgccggatatcagtacggtgtttacgatccacaacttagcctaccaagggccttggcggggtttcctggagcgcaatacttggtgtccctggtatatggatggtgataacgtgatggcttcggcgctgatgtttgccgatcaggtgaacaccgtatctcccacctatgcccaacaaatccaaaccaaagtctatggtgaaaaattagagggtttgttgtcttggatcagtggcaaaagtcgcggcatcgtgaatggtattgacgtagaactttataatccttctaacgatcaagccctggtgaagcaattttctacgactaatcttgaggatcgggccgccaacaaagtgattatccaagaagaaacggggctagaggtcaactccaaggcttttttgatggcgatggtcacccgcttagtggaacaaaagggcattgatctgctgctaaatatcctggagcagtttatggcatacactgacgcccagctcattatcctcggcactggcgatcgccactacgaaacccaactctggcagactgcctaccgctttaaggggcggatgtccgtgcaactgctctataatgatgccctctcccgccggatttacgctggatccgatgtctttttgatgccgtcacgctttgagccctgtggcattagtcaaatgatggcgatgcgctacggttctgtaccgattgtgcggcgcaccgggggtttggtggatacggtctctttccatgatccgattcaccaaaccgggacaggctttagttttgaccgctacgaaccgctggatatgtacacctgcatggtgcgggcttgggaaagtttccgctacaaaaaagactgggctgaactacaaagacgaggcatgagccatgactttagttggtacaaatctgccggggaatatctcaagatgtaccgccaaagcattaaagaagctccggaattaacgaccgatgaagccgaaaaaatcacctatttagtgaaaaaacacgccatttaa

SEQ ID NO: 38 - DNA, 1542 bp, Synechococcus sp. WH8102
atgcgcatcctcttcgctgccgcggaatgcgccccgatgatcaaggtcggtggcatgggggatgtggtgggatcgctgcctccggctctggccaagcttggccacgacgtgcggctgatcatgccgggctactccaagctctggaccaagctgacgatctcggacgaacccatctggcgcgcccagacgatgggtacggaattcgcggtttacgagacgaagcatccaggcaatgggatgaccatctacctggtgggacatccggtgttcgatcccgagcggatctatggcggtgaagatgaggactggcgcttcaccttctttgccagtgccgccgctgaattcgcctggaatgtctggaagccgaatgttcttcactgccacgactggcacaccggcatgattccggtctggatgcaccaggacccggagatcagcacggtcttcaccatccacaacctcaagtaccagggcccctggcgttggaagctggatcgcatcacctggtgcccctggtacatgcagggagatcacaccatggcggcggcacttctgtacgccgaccgggtcaacgccgtctcccccacctacgccgaggaaatccgtacggcggagtacggcgaaaagctggatggtttgctcaatttcgtctccggcaagctgcgcggcatcctcaatggcattgacctcgaggcctggaacccccagaccgatggggctctgccggccaccttcagcgccgacgacctctccggtaaagcggtctgcaagcgggtgttgcaggagcgcatgggtcttgaggtgcgtgacgacgcctttgtcctcggcatggtcagccgactcgtcgatcagaagggcgtcgatctgcttctgcaggtggcggaccgtttgctcgcctacaccgacacgcagatcgtggtgctcggcaccggtgaccgtggcctggaatccggcctgtggcagctggcctcccgccatgccggccgttgcgccgtcttcctcacctacgacgacgacctctcccgactgatctatgccggcagtgacgccttcctgatgcccagtcgcttcgagccctgcggcatcagccagctgtacgccatgcgttacggctccgttcctgtggtgcgcaaggtgggcggcctggtggacaccgttcctccccacagtccagctgatgccagcgggaccggcttctgcttcgatcgttttgagccggtcgacttctacaccgcattggtgcgtgcctgggaggcctaccgccatcgcgacagctggcaggagttgcagaagcgcggcatgcagcaggactacagctgggaccgttcggccatcgattacgacgtcatgtaccgcgatgtctgcggtctgaaggaacccacccctgatgccgcgatggtggaacagttctcccagggacaggctgcggatccctcccgcccagaggatgatgcgatcaatgctgctcccgaggcggtcaccgcgccgtccggccccagccgcaacccccttaatcgtctcttcggccgcagggccgactga

SEQ ID NO: 39 - DNA, 1524 bp, Synechococcus sp RCC 307
atgcgcatcctctttgctgcggccgaatgcgcaccgatggtgaaagtcggcggcatgggagatgtggtgggatctctgcctccagccctcgctgagttgggtcacgacgtgcgcgtgatcatgcccggctacggcaagctctggtcccagcttgatgtgcccagcgagccgatctggcgtgcccaaaccatgggcaccgattttgctgtctatgagacccgtcaccccaagaccgggctcacgatctatttggtgggccatccggtttttgatggtgagcgcatctatggaggtgaagacgaggactggcgcttcaccttcttcgctagcgccacctccgaatttgcctggaacgcttggaagccccaggtgctgcattgccatgactggcacaccggcatgattccggtgtggatgcaccaagaccccgagatcagcacggtcttcaccatccacaacctcaaatatcaaggtccctggcgctggaagctcgagcgcatgacctggtgcccctggtacatgcagggcgaccacaccatggcggcagccttgctgtatgccgaccgcgtcaatgcggtttcacccacctacgcccaagagatccgcacgccggaatacggcgaacaactggaggggttgctgaactacatcagcggcaagctgcgaggcatcctcaatggcatcgatgtggaggcttggaatcccgccactgattcgcggattccggccacctacagcactgctgacctcagtggcaaagccgtctgcaagcgggctctgcaagagcgcatggggcttcaggtgaaccccgacacctttgtgatcggtttggtgagccgtttggtggaccaaaaaggcgtcgacctgctgctgcaggttgccgaacgcttccttgcctacaccgatacgcagatcgttgtgttgggcaccggggatcgccatttggaatcgggcctgtggcaaatggcgagtcagcacagcggccgcttcgcttccttcctcacctacgacgatgatctctcccggctgatctacgccggcagtgatgccttcttgatgccctcgcgctttgagccctgcggcatcagccagttgctctcgatgcgctacggcaccatcccggtggtgcgccgcgtcggtggactggtcgacaccgtgcctccctatgttcccgccacccaagagggcaatggcttctgcttcgaccgctatgaagcgatcgacctttacaccgccttggtgcgcgcctgggaggcctaccgccatcaagacagctggcagcaattgatgaagcgggtgatgcaggttgatttcagctgggctcgttccgccttggaatacgaccgcatgtatcgcgatgtttgcggaatgaaggagcccacgccggaagccgatgcggtggcggccttctccattccccagccgcctgaacagcaggccgcacgtgctgccgctgaagccgctgaccccaacccccaacggcgctttaatccccttggattgctgcgccgaaacggcggttga

SEQ ID NO: 40 - DNA, 1383 bp, Trichodesmium erythraeum IMS 101
atgcgaattttatttgtgtctgctgaagcgactcctttagcaaaagttggtggtatggcagatgtagtgggtgccttacccaaagtactacggaaaatgggtcacgatgttcgtatcttcatgccttattatggctttttaggcgacaagatggaagttcctgaggaacctatctgggaaggaacggccatgtatcaaaactttaagatttatgagacggtactaccaaaaagtgacgtgccattgtacctatttggtcacccggctttttggccacgtcatatttactatggagatgatgaggactggagattcactctatttgctaatggggcggccgagttttgctggaatggctggaaaccagagatagttcattgtaatgactggcacactggcatgattccagtttggatgcacgaaactccagacattaaaaccgtatttactattcataacctagcttatcaaggaccttggcgctggtacttggaaagaattacttggtgtccttggtacatggaagggcataatacaatggcagcagcagttcagtttgcagatcgggtaactactgtttctccaacctatgctagtcagatccaaacacctgcctacggagaaaatctagatggtttaatgtcttttattacggggaaactacacggtatcctcaatggtattgatatgaacttttataatccagctaatgacagatatattcctcaaacttatgatgtcaataccctggaaaaacgggttgacaataaaattgctcttcaagaagaagtaggttttgaagttaacaaaaatagctttctcatgggaatggtctcccgactggtagaacaaaaaggacttgatttaatgctgcaagtcttagatcggtttatggcttatactgatactcagtttattttgttgggtacaggcgatcgcttctatgaaacccaaatgtggcaaatagcaagtcgttatcctggtcggatgagtgtccaacttttacataatgatgccctttcccgacgaatatatgcaggtactgatgctttcttaatgcccagtcgatttgagccttgtggtattagtcagttattggcaatgcgttatggtagtatacctattgtccgtcgcacaggtgggttagttgatactgtctctttctatgatcctattaataatgtaggtactggctattcttttgatcgctatgaaccactagacctgcttactgcaatggtccgagcctatgaaggtttccggttcaaagatcaatggcaggagttacagaagcgtggcatgagagagaactttagctgggataagtcagctcaaggttatatcaaaatgtacaaatcaatgctcggattacctgaagaataa

SEQ ID NO: 41 - DNA, 1419 bp, Anabaena variabilis
atgcggattctatttgtggcagcagaagcagcacccatcgcaaaagtaggagggatgggtgatgttgtcggtgcattacctaaggtcttgagaaaaatggggcatgatgtgcgtatcttcttgccctattacggctttttgccagacaaaatggaaattcccaaagatccaatctggaagggatacgccatgtttcaggactttacagttcacgaagcagttctgcctggtactgatgttcccttgtatttatttggacatccagccttcaacccccggcgaatttattcgggagatgatgaagactggcggttcaccttgttttccaatggtgcggcggaattttgttggaattactggaaaccagaaattattcactgtcacgattggcacacaggcatgattcctgtgtggatgaaccaatcaccagatatcaccacagtcttcactatccacaacctagcttaccaagggccttggcgttggtatctagataaaattacttggtgtccttggtatatgcagggacacaacacaatggcggcggctgtccagtttgctgacagagtaaataccgtttctcctacatacgccgagcaaatcaagaccccggcttacggtgagaaaatagaaggcttgctgtctttcatcagtggtaaattatctgggattgttaacggtatagatacggaagtttatgacccagctaatgataaatttattgctcaaacttttactgctgatactttagataaacgcaaagccaacaaaattgctttacaagaagaagtagggttagaagttaacagcaatgcctttttaattggcatggtgacaaggttagtcgagcagaagggtttagatttagtcatccaaatgctcgatcgctttatggcttatactgatgctcagttcgtcttgttaggaacaggcgatcgctactacgaaactcaaatgtggcaattagcatcccgctaccccggacgtatggccacctatctcctatacaatgatgccctatcccgccgcatctacgccggttctgatgcctttttaatgcccagccgctttgaaccatgcggtattagccagatgatggctttacgctacggttccatccccatcgttcgccgcactgggggtttagttgacaccgtatcccaccacgaccccgtaaacgaagccggtacaggctactgctttgaccgctacgaacccctagacttattcacctgcatgattcgcgcctgggaaggcttccgctacaaaccccaatggcaagaactacaaaagcgtggtatgagtcaagacttcagctggtacaaatccgctaaggaatacgacagactctatcgctcaatatacggtttgccagaagcagaagagacacagccagagttaattctggcaaatcagtag

SEQ ID NO: 42 - DNA, 1419 bp, Nostoc sp. PCC 7120
atgcggattctatttgtggcagcagaagcagcacccattgcaaaagtaggagggatgggtgatgttgtcggtgcattacctaaggtcttgagaaaaatggggcatgatgtacgtatcttcttgccctattacggctttttgccagacaaaatggagattcccaaagatccaatatggaagggatacgccatgtttcaggactttacagttcacgaagcagttctgcctggtactgatgttcccttgtatttatttggacatccagcctttaccccccggcggatttattcgggagatgatgaagactggcgcttcaccttgttttccaatggtgcggctgagttttgctggaattactggaaacccgacattattcactgtcatgattggcacacgggcatgattcctgtgtggatgaaccaatcaccagatatcaccacagtcttcactatccacaatctggcttaccaagggccttggcgttggtatttagataaaattacttggtgtccttggtatatgcagggacacaacacaatggcggcggctgtccagtttgcggacagggtaaatacagtttctcccacatacgccgagcaaatcaagaccccggcttacggtgagaaaatagaaggtttgctgtctttcatcagtggtaaattatctgggattgttaacggtatagatacggaagtttacgacccagctaatgataaatatattgctcaaacgttcactgccgatactttagataaacgcaaagccaacaaaattgctttacaagaagaagtaggattagaagttaacagcaatgcctttttaattggcatggtgacaaggttagtcgagcagaagggcttagatttagtcatccaaatgctcgatcgctttatggcttatactgatgctcagttcgtcttgttgggaacaggcgatcgctactacgaaacccaaatgtggcaattagcatcccgctaccccggtcgtatggctacttacctcctgtataacgatgccctatctcgccgcatctacgctggtactgatgcctttttgatgcccagtcgctttgaaccatgcggtattagtcaaatgatggctttacgctacggttccattcccatcgtccgccgcactggaggcttggttgacaccgtatcccaccacgaccccatcaacgaagcaggtacaggctactgcttcgaccgctacgaacccctcgacttatttacctgcatgattcgcgcctgggaaggcttccgctacaaaccacaatggcaagaactacaaaaacgcggtatgagtcaagacttcagctggtacaaatccgctaaggaatacgacaaactctatcgctcaatgtacggtttgccagacccagaagagacacagccggagttaattctgacaaatcagtag

SEQ ID NO: 43 - DNA, 1953 bp, Synechococcus elongatus PCC 7942 0918
atggtgactggaaccgccctcgcgcaaccccgcgccattacgccccacgaacagcagcttttggccaaactgaaaagctatcgcgatatccaaagcttgtcgcaaatttggggacgtgctgccagtcaatttggatcgatgccggctttggttgcaccccatgccaaaccagcgatcaccctcagttatcaagaattggcgattcagatccaagcgtttgcagccggactgctcgcgctgggagtgcctacctccacagccgatgactttccgcctcgcttggcgcagtttgcggataacagcccccgctggttgattgctgaccaaggcacgttgctggcaggggctgccaatgcggtgcgcggcgcccaagctgaagtatcggagctgctctacgtcttagaggacagcggttcgatcggcttgattgtcgaagacgcggcgctgctgaagaaactacagcctggtttagcgtcactatcgctgcagtttgtgatcgtgctcagcgatgaagtagtcgagatcgacagcctgcgcgtcgttggttttagtgacgtgctggagatggggcgatcgctgccggcaccggagccaattttgcagctcgatcgcttagccactttgatctatacctcgggcaccacaggcccaccgaagggcgtgatgctttctcacggcaacctgctgcaccaagtcacaacattaggtgtggttgtgcagccgcaacctggcgacaccgtgctgagtattttgccgacttggcactcctacgagcgagcttgtgaatatttcctgctctcccagggctgcacacaggtctacacgacgctgcgcaatgtcaaacaagacatccggcagtatcggccgcagttcatggtcagtgtgctgcgcctctgggaatcgatctacgagggcgtgcagaagcagtttcgcgagcaaccggcgaagaaacgtcgcttgatcgataccttctttggcttgagtcaacgctatgttttggcacggcgccgctggcaaggactggatttgctggcactgaaccaatccccagcccagcgcctcgctgagggtgtccggatgttggcgctagcaccgttgcataagctgggcgatcgcctcgtctacggcaaagtacgagaagccacgggtggccgaattcggcaggtgatcagtggcggtggctcactggcactgcacctcgataccttcttcgaaattgttggtgttgatttgctggtgggttatggcttgacagaaacctcaccagtgctgacggggcgacggccttggcacaacctacggggttcggccggtcagccgattccaggtacggcgattcggatcgtcgatcctgaaacgaaggaaaaccgacccagtggcgatcgcggcttggtgctggcgaaagggccgcaaatcatgcagggctacttcaataaacccgaggcgaccgcgaaagcgatcgatgccgaaggttggtttgacaccggcgacttaggctacatcgtcggtgaaggcaacttggtgctaacggggcgcgctaaggacacgatcgtgctgaccaatggcgaaaacattgaaccccagccgattgaagatgcctgcctacgaagttcctatatcagccaaatcatgttggtgggacaagaccgcaagagtttgggggcgttgattgtgcccaatcaagaggcgatcgcactctgggccagcgaacagggcatcagccaaaccgatctgcagggagtggtacagaagctgattcgcgaggaactgaaccgcgaagtgcgcgatcgcccgggctaccgcatcgacgatcgcattggaccattccgcctcatcgaagaaccgttcagcatggaaaatggccagctaacccaaaccctgaaaatccgtcgcaacgttgtcgcggaacactacgcggctatgatcgacgggatgtttgaatcggcgagttaa

SEQ ID NO: 44 - protein, 650 aa, Synechococcus elongatus PCC 7942 0918
MVTGTALAQPRAITPHEQQLLAKLKSYRDIQSLSQIWGRAASQFGSMPALVAPHAKPAITLSYQELAIQIQAFAAGLLALGVPTSTADDFPPRLAQFADNSPRWLIADQGTLLAGAANAVRGAQAEVSELLYVLEDSGSIGLIVEDAALLKKLQPGLASLSLQFVIVLSDEVVEIDSLRVVGFSDVLEMGRSLPAPEPILQLDRLATLIYTSGTTGPPKGVMLSHGNLLHQVTTLGVVVQPQPGDTVLSILPTWHSYERACEYFLLSQGCTQVYTTLRNVKQDIRQYRPQFMVSVLRLWESIYEGVQKQFREQPAKKRRLIDTFFGLSQRYVLARRRWQGLDLLALNQSPAQRLAEGVRMLALAPLHKLGDRLVYGKVREATGGRIRQVISGGGSLALHLDTFFEIVGVDLLVGYGLTETSPVLTGRRPWHNLRGSAGQPIPGTAIRIVDPETKENRPSGDRGLVLAKGPQIMQGYFNKPEATAKAIDAEGWFDTGDLGYIVGEGNLVLTGRAKDTIVLTNGENIEPQPIEDACLRSSYISQIMLVGQDRKSLGALIVPNQEAIALWASEQGISQTDLQGVVQKLIREELNREVRDRPGYRIDDRIGPFRLIEEPFSMENGQLTQTLKIRRNVVAEHYAAMIDGMFESAS

SEQ ID NO: 45 - protein, 325 aa, Synechococcus sp. PCC7002
MPKTERRTFLLDFEKPLSELESRIHQIRDLAAENNVDVSEQIQQLEARADQLREEIFSTLTPAQRLQLARHPRRPSTLDYVQMMADEWFELHGDRGGSDDPALIGGVARFDGQPVMMLGHQKGRDTKDNVARNFGMPAPGGYRKAMRLMDHANRFGMPILTFIDTPGAWAGLEAEKLGQGEAIAFNLREMFSLDVPIICTVIGEGGSGGALGIGVGDRVLMLKNSVYTVATPEACAAILWKDAGKSEQAAAALKITAEDLKSLEIIDEIVPEPASCAHADPIGAAQLLKAAIQDNLQALLKLTPERRRELRYQRFRKIGVFLESS

SEQ ID NO: 46 - protein, 165 aa, Synechococcus sp. PCC 7002
MAINLQEIQELLSTIGQTNVTEFELKTDDFELRVSKGTVVAAPQTMVMSEAIAQPAMSTPVVSQATATPEASQAETPAPSVSIDDKWVAITSPMVGTFYRAPAPGEDPFVAVGDRVGNGQTVCIIEAMKLMNEIEAEVSGEVVKIAVEDGEPIEFGQTLMWVNPT

SEQ ID NO: 47 - protein, 448 aa, Synechococcus sp. PCC 7002
MQFSKILIANRGEVALRIIHTCQELGIATVAVHSTVDRQALHVQLADESICIGPPQSSKSYLNIPNIIAAALSSNADAIHPGYGFLAENAKFAEICADHQITFIGPSPEAMIAMGDKSTAKKTMQAAKVPTVPGSAGLVASEEQALEIAQQIGYPVMIKATAGGGGRGMRLVPSAEELPRLYRAAQGEAEAAFGNGGVYIEKFIERPRHIEFQILADQYGNVIHLGERDCSIQRRHQKLLEEAPSAILTPRLRDKMGKAAVKAAKSIDYVGAGTVEFLVDKNGDFYFMEMNTRIQVEHPVTEMVTGLDLIAEQIKVAQGDRLSLNQNQVNLNGHAIECRINAEDPDHDFRPTPGKISGYLPPGGPGVRMDSHVYTDYEISPYYDSLIGKLIVWGPDRDTAIRRMKRALRECAITGVSTTISFHQKILNHPAFLAADVDTNFIQQHMLP

SEQ ID NO: 48 - protein, 319 aa, Synechococcus sp. PCC 7002
MSLFDWFAANRQNSETQLQPQQEREIADGLWTKCKSCDALTYTKDLRNNQMVCKECGFHNRVGSRERVRQLIDEGTWTEISQNVAPTDPLKFRDKKAYSDRLKDYQEKTNLTDAVITGTGLIDGLPLALAVMDFGFMGGSMGSVVGEKICRLVEHGTAEGLPVVVVCASGGARMQEGMLSLMQMAKISGALERHRTKKLLYIPVLTNPTTGGVTASFAMLGDLILAEPKATIGFAGRRVIEQTLREKLPDDFQTSEYLLQHGFVDAIVPRTELKKTLAQMISLHQPFHPILPELQLAPHVEKEKVYEPIASTSTNDFYK

SEQ ID NO: 49 - protein, 2311 aa, Triticum aestivum
MGSTHLPIVGLNASTTPSLSTIRPVNSAGAAFQPSAPSRTSKKKSRRVQSLRDGGDGGVSDPNQSIRQGLAGIIDLPKEGTSAPEVDISHGSEEPRGSYQMNGILNEAHNGRHASLSKVVEFCMALGGKTPIHSVLVANNGRAAAKFMRSVRTWANETFGSEKAIQLIAMATPEDMRINAEHIRIADQFVEVPGGTNNNNYANVQLIVEIAVRTGVSAVWPGWGHASENPELPDALNANGIVFLGPPSSSMNALGDKVGSALIAQAAGVPTLPWGGSQVEIPLEVCLDSIPAEMYRKACVSTTEEALASCQMIGYPAMIKASWGGGGKGIRKVNNDDDVRALFKQVQGEVPGSPIFIMRLASQSRHLEVQLLCDQYGNVAALHSRDCSVQRRHQKIIEEGPVTVAPRETVKELEQAARRLAKAVGYVGAATVEYLYSMETGEYYFLELNPRLQVEHPVTEWIAEVNLPAAQVAVGMGIPLWQVPEIRRFYGMDNGGGYDIWRETAALATPFNFDEVDSQWPKGHCVAVRITSEDPDDGFKPTGGKVKEISFKSKPNVWAYFSVKSGGGIHEFADSQFGHVFAYGVSRAAAITNMSLALKEIQIRGEIHSNVDYTVDLLNASDFKENRIHTGWLDNRIAMRVQAERPPWYISVVGGALYKTITSNTDTVSEYVSYLVKGQIPPKHISLVHSTVSLNIEESKYTIETIRSGQGSYRLRMNGSVIEANVQTLCDGGLLMQLDGNSHVIYAEEEAGGTRLLIDGKTYLLQNDHDPSRLLAETPCKLLRFLVADGAHVEADVPYAEVEVMKMCMPLLSPAAGVINVLLSEGQPMQAGDLIARLDLDDPSAVKRAEPFNGSFPEMSLPIAASGQVHKRCATSLNAARMVLAGYDHPINKVVQDLVSCLDAPELPFLQWEELMSVLATRLPRLLKSELEGKYSEYKLNVGHGKSKDFPSKMLREIIEENLAHGSEKEIATNERLVEPLMSLLKSYEGGRESHAHFIVKSLFEDYLSVEELFSDGIQSDVIERLRQQHSKDLQKVVDIVLSHQGVRNKTKLILTLMEKLVYPNPAVYKDQLTRFSSLNHKRYYKLALKASELLEQTKLSELRTSIARSLSELEMFTEERTAISEIMGDLVTAPLPVEDALVSLFDCSDQTLQQRVIETYISRLYQPHLVKDSIQLKYQESGVIALWEFAEAHSEKRLGAMVIVKSLESVSAAIGAALKGTSRYASSEGNIMHIALLGADNQMHGTEDSGDNDQAQVRIDKLSATLEQNTVTADLRAAGVKVISCIVQRDGALMPMRHTFLLSDEKLCYGEEPVLRHVEPPLSALLELGKLKVKGYNEVKYTPSRDRQWNIYTLRNTENPKMLHRVFFRTLVRQPGASNKFTSGNISDVEVGGAEESLSFTSSSILRSLMTAIEELELHAIRTGHSHMFLCILKERKLLDLVPVSGNKVVDIGQDEATACLLLKEMALQIHELVGARMHHLSVCQWEVKLKLDSDGPASGTWRVVTTNVTSHTCTVDIYREVEDTESQKLVYHSAPSSSGPLHGVALNTPYQPLSVIDLKRCSARNNRTTYCYDFPLAFETAVQKSWSNISSDNNRCYVKATELVFAHKNGSWGTPVIPMERPAGLNDIGMVAWILDMSTPEYPNGRQIVVIANDITFRAGSFGPREDAFFETVTNLACERRLPLIYLAANSGARIGIADEVKSCFRVGWSDDGSPERGFQYIYLTEEDHARISASVIAHKMQLDNGEIRWVIDSVVGKEDGLGVENIHGSAAIASAYSRAYEETFTLTFVTGRTVGIGAYLARLGIRCIQRTDQPIILTGFSALNKLLGREVYSSHMQLGGPKIMATNGVVHLTVSDDLEGVSNILRWLSYVPANIGGPLPITKSLDPPDRPVAYIPENTCDPRAAISGIDDSQGKWLGGMFDKDSFVETFEGWAKSVVTGRAKLGGIPVGVIAVETQTMMQLIPADPGQLDSHERSVPRAGQVWFPDSATKTAQAMLDFNREGLPLFILANWRGFSGGQRDLFEGILQAGSTIVENLRAYNQPAFVYIPKAAELRGGAWVVIDSKINPDRIEFYAERTAKGNVLEPQGLIEIKFRSEELQECMGRLDPELINLKAKLQGVKHENGSLPESESLQKSIEARKKQLLPLYTQIAVRFAELHDTSLRMAAKGVIKKVVDWEDSRSFFYKRLRRRISEDVLAKEIRGVSGKQFSHQSAIELIQKWYLASKGAETGSTEWDDDDAFVAWRENPENYQEYIKEPRAQRVSQLLSDVADSSPDLEALPQGLSMLLEKMDPAKREIVEDFEINLVK

SEQ ID NO: 50 - DNA, 978 bp, Synechococcus sp. PCC 7002
atgccgaaaacggagcgccggacgtttctgcttgattttgaaaaacctctttcggaattagaatcacgcatccatcaaattcgtgatcttgctgcggagaataatgttgatgtttcagaacagattcagcagctagaggcgcgggcagaccagctccgggaagaaatttttagtaccctcaccccggcccaacggctgcaattggcacggcatccccggcgtcccagcacccttgattatgttcaaatgatggcggacgaatggtttgaactccatggcgatcgcggtggatctgatgatccggctctcattggcggggtggcccgcttcgatggtcaaccggtgatgatgctagggcaccaaaaaggacgggatacgaaggataatgtcgcccgcaattttggcatgccagctcctgggggctaccgtaaggcgatgcggctgatggaccatgccaaccgttttgggatgccgattttaacgtttattgatactcctggggcttgggcgggtttagaagcggaaaagttgggccaaggggaggcgatcgcctttaacctccgggaaatgtttagcctcgatgtgccgattatttgcacggtcattggcgaaggcggttccggtggggccttagggattggcgtgggcgatcgcgtcttgatgttaaaaaattccgtttacacagtggcgaccccagaggcttgtgccgccattctctggaaagatgccgggaaatcagagcaggccgccgccgccctcaagattacagcagaggatctgaaaagccttgagattatcgatgaaattgtcccagagccagcctcctgcgcccacgccgatcccattggggccgcccaactcctgaaagcagcgatccaagataacctccaagccttgctgaagctgacgccagaacgccgccgtgaattgcgctaccagcggttccggaaaattggtgtgtttttagaaagttcctaa

SEQ ID NO: 51 - DNA, 498 bp, Synechococcus sp.  PCC 7002
atggctattaatttacaagagatccaagaacttctatccaccatcggccaaaccaatgtcaccgagtttgaactcaaaaccgatgattttgaactccgtgtgagcaaaggtactgttgtggctgctccccagacgatggtgatgtccgaggcgatcgcccaaccagcaatgtccactcccgttgtttctcaagcaactgcaaccccagaagcctcccaagcggaaaccccggctcccagtgtgagcattgatgataagtgggtcgccattacctcccccatggtgggaacgttttaccgcgcgccggcccctggtgaagatcccttcgttgccgttggcgatcgcgttggcaatggtcaaaccgtttgcatcatcgaagcgatgaaattaatgaatgagattgaggcagaagtcagcggtgaagttgttaaaattgccgttgaagacggtgaacccattgaatttggtcagaccctaatgtgggtcaacccaacctaa

SEQ ID NO: 52 - DNA, 1347 bp, Synechococcus sp. PCC 7002
atgcagttttcaaagattctcatcgccaatcgcggagaagttgccctacgcattatccacacctgtcaggagctcggcattgccacagttgccgtccactccaccgtagatcgccaagccctccacgttcagctcgccgatgagagcatttgcattggcccgccccagagcagcaaaagctatctcaacattcccaatattatcgctgcggccctcagcagtaacgccgacgcaatccacccaggctacggtttcctcgctgaaaatgccaagtttgcagaaatttgtgccgaccaccaaatcaccttcattggcccttccccagaagcaatgatcgccatgggggacaaatccaccgccaaaaaaacgatgcaggcggcaaaagtccctaccgtacccggtagtgctgggttggtggcctccgaagaacaagccctagaaatcgcccaacaaattggctaccctgtgatgatcaaagccacggcgggtggtggtggccgggggatgcgccttgtgcccagcgctgaggagttaccccgtttgtaccgagcggcccagggggaagcagaagcagcctttgggaatggcggcgtttacatcgaaaaatttattgaacggccccgtcacatcgaatttcagatcctcgcggatcagtacggcaatgtaattcacctcggcgaacgggattgttcgatccaacggcggcaccaaaaactcctcgaagaagctcccagcgcgatcctcacccccagactgcgggacaaaatggggaaagcggcagtaaaagcggcgaaatccattgattatgtcggggcggggacggtggaattcctcgtggataagaatggggatttctactttatggaaatgaatacccgcattcaggtggaacacccggtcacagagatggtgacgggactagatctgatcgccgagcaaattaaagttgcccaaggcgatcgcctcagtttgaatcaaaatcaagtgaacttgaatggtcatgccatcgagtgccggattaatgccgaagatcccgaccatgatttccgaccgaccccaggcaaaatcagtggctatcttccccccggtggccctggggtacggatggattcccacgtttacaccgactatgaaatttctccttactacgattctttgatcggtaaattaatcgtttggggaccagaccgagacaccgccattcgccgcatgaagcgggcactccgagaatgtgccattactggagtatcgaccaccattagcttccaccaaaagattttgaatcatccggcttttttggcggccgatgtcgatacaaactttatccagcagcacatgttgccctag

SEQ ID NO: 53 - DNA, 960 bp, Synechococcus sp. PCC 7002
atgtctctttttgattggtttgccgcaaatcgccaaaattctgaaacccagctccagccccaacaggagcgcgagattgccgatggcctctggacgaaatgcaaatcctgcgatgctctcacctacactaaagacctccgcaacaatcaaatggtctgtaaagagtgtggcttccataaccgggtcggcagtcgggaacgggtacgccaattgattgacgaaggcacctggacagaaattagtcagaatgtcgcgccgaccgaccccctgaaattccgcgacaaaaaagcctatagcgatcgcctcaaagattaccaagagaaaacgaacctcaccgatgctgtaatcactggcacaggactgattgacggtttaccccttgctttggcagtgatggactttggctttatgggcggcagcatgggatccgttgtcggcgaaaaaatttgtcgcctcgtagaacatggcaccgccgaaggtttacccgtggtggttgtttgtgcttctggtggagcaagaatgcaagagggcatgctcagtctgatgcagatggcgaaaatctctggtgccctcgaacgccatcgcaccaaaaaattactctacatccctgttttgactaatcccaccaccgggggcgtcaccgctagctttgcgatgttgggcgatttgattcttgccgaacccaaagcaaccatcggttttgctggacgccgcgtcattgaacaaacattgcgcgaaaaacttcctgacgattttcagacatctgaatatttactccaacatgggtttgtggatgcgattgtgccccgcactgaattgaaaaaaaccctcgcccaaatgattagtctccatcagccctttcacccgattctgccagagctacaattggctccccatgtggaaaaagaaaaagtttacgaacccattgcctctacttcaaccaacgacttttacaagtag

SEQ ID NO: 54 - DNA, 6936 bp, Triticum aestivum
atgggatccacacatttgcccattgtcggccttaatgcctcgacaacaccatcgctatccactattcgcccggtaaattcagccggtgctgcattccaaccatctgccccttctagaacctccaagaagaaaagtcgtcgtgttcagtcattaagggatggaggcgatggaggcgtgtcagaccctaaccagtctattcgccaaggtcttgccggcatcattgacctcccaaaggagggcacatcagctccggaagtggatatttcacatgggtccgaagaacccaggggctcctaccaaatgaatgggatactgaatgaagcacataatgggaggcatgcttcgctgtctaaggttgtcgaattttgtatggcattgggcggcaaaacaccaattcacagtgtattagttgcgaacaatggaagggcagcagctaagttcatgcggagtgtccgaacatgggctaatgaaacatttgggtcagagaaggcaattcagttgatagctatggctactccagaagacatgaggataaatgcagagcacattagaattgctgatcaatttgttgaagtacccggtggaacaaacaataacaactatgcaaatgtccaactcatagtggagatagcagtgagaaccggtgtttctgctgtttggcctggttggggccatgcatctgagaatcctgaacttccagatgcactaaatgcaaacggaattgtttttcttgggccaccatcatcatcaatgaacgcactaggtgacaaggttggttcagctctcattgctcaagcagcaggggttccgactcttccttggggtggatcacaggtggaaattccattagaagtttgtttggactcgatacctgcggagatgtataggaaagcttgtgttagtactacggaggaagcacttgcgagttgtcagatgattgggtatccagccatgattaaagcatcatggggtggtggtggtaaagggatccgaaaggttaataacgacgatgatgtcagagcactgtttaagcaagtgcaaggtgaagttcctggctccccaatatttatcatgagacttgcatctcagagtcgacatcttgaagttcagttgctttgtgatcaatatggcaatgtagctgcgcttcacagtcgtgactgcagtgtgcaacggcgacaccaaaagattattgaggaaggaccagttactgttgctcctcgcgagacagtgaaagagctagagcaagcagcaaggaggcttgctaaggctgtgggttatgttggtgctgctactgttgaatatctctacagcatggagactggtgaatactattttctggaacttaatccacggttgcaggttgagcatccagtcaccgagtggatagctgaagtaaacttgcctgcagctcaagttgcagttggaatgggtatacccctttggcaggttccagagatcagacgtttctatggaatggacaatggaggaggctatgacatttggagggaaacagcagctcttgctactccatttaacttcgatgaagtggattctcaatggccaaagggtcattgtgtagcagttaggataaccagtgaggatccagatgacggattcaagcctaccggtggaaaagtaaaggagatcagttttaaaagcaagccaaatgtttgggcctatttctctgttaagtccggtggaggcattcatgaatttgctgattctcagtttggacatgtttttgcatatggagtgtctagagcagcagcaataaccaacatgtctcttgcgctaaaagagattcaaattcgtggagaaattcattcaaatgttgattacacagttgatctcttgaatgcctcagacttcaaagaaaacaggattcatactggctggctggataacagaatagcaatgcgagtccaagctgagagacctccgtggtatatttcagtggttggaggagctctatataaaacaataacgagcaacacagacactgtttctgaatatgttagctatctcgtcaagggtcagattccaccgaagcatatatcccttgtccattcaactgtttctttgaatatagaggaaagcaaatatacaattgaaactataaggagcggacagggtagctacagattgcgaatgaatggatcagttattgaagcaaatgtccaaacattatgtgatggtggacttttaatgcagttggatggaaacagccatgtaatttatgctgaagaagaggccggtggtacacggcttctaattgatggaaagacatacttgttacagaatgatcacgatccttcaaggttattagctgagacaccctgcaaacttcttcgtttcttggttgccgatggtgctcatgttgaagctgatgtaccatatgcggaagttgaggttatgaagatgtgcatgcccctcttgtcacctgctgctggtgtcattaatgttttgttgtctgagggccagcctatgcaggctggtgatcttatagcaagacttgatcttgatgacccttctgctgtgaagagagctgagccatttaacggatctttcccagaaatgagccttcctattgctgcttctggccaagttcacaaaagatgtgccacaagcttgaatgctgctcggatggtccttgcaggatatgatcacccgatcaacaaagttgtacaagatctggtatcctgtctagatgctcctgagcttcctttcctacaatgggaagagcttatgtctgttttagcaactagacttccaaggcttcttaagagcgagttggagggtaaatacagtgaatataagttaaatgttggccatgggaagagcaaggatttcccttccaagatgctaagagagataatcgaggaaaatcttgcacatggttctgagaaggaaattgctacaaatgagaggcttgttgagcctcttatgagcctactgaagtcatatgagggtggcagagaaagccatgcacactttattgtgaagtcccttttcgaggactatctctcggttgaggaactattcagtgatggcattcagtctgatgtgattgaacgcctgcgccaacaacatagtaaagatctccagaaggttgtagacattgtgttgtctcaccagggtgtgagaaacaaaactaagctgatactaacactcatggagaaactggtctatccaaaccctgctgtctacaaggatcagttgactcgcttttcctccctcaatcacaaaagatattataagttggcccttaaagctagcgagcttcttgaacaaaccaagcttagtgagctccgcacaagcattgcaaggagcctttcagaacttgagatgtttactgaagaaaggacggccattagtgagatcatgggagatttagtgactgccccactgccagttgaagatgcactggtttctttgtttgattgtagtgatcaaactcttcagcagagggtgatcgagacgtacatatctcgattataccagcctcatcttgtcaaggatagtatccagctgaaatatcaggaatctggtgttattgctttatgggaattcgctgaagcgcattcagagaagagattgggtgctatggttattgtgaagtcgttagaatctgtatcagcagcaattggagctgcactaaagggtacatcacgctatgcaagctctgagggtaacataatgcatattgctttattgggtgctgataatcaaatgcatggaactgaagacagtggtgataacgatcaagctcaagtcaggatagacaaactttctgcgacactggaacaaaatactgtcacagctgatctccgtgctgctggtgtgaaggttattagttgcattgttcaaagggatggagcactcatgcctatgcgccataccttcctcttgtcggatgaaaagctttgttatggggaagagccggttctccggcatgtggagcctcctctttctgctcttcttgagttgggtaagttgaaagtgaaaggatacaatgaggtgaagtatacaccgtcacgtgatcgtcagtggaacatatacacacttagaaatacagagaaccccaaaatgttgcacagggtgtttttccgaactcttgtcaggcaacccggtgcttccaacaaattcacatcaggcaacatcagtgatgttgaagtgggaggagctgaggaatctctttcatttacatcgagcagcatattaagatcgctgatgactgctatagaagagttggagcttcacgcgattaggacaggtcactctcatatgtttttgtgcatattgaaagagcgaaagcttcttgatcttgttcccgtttcagggaacaaagttgtggatattggccaagatgaagctactgcatgcttgcttctgaaagaaatggctctacagatacatgaacttgtgggtgcaaggatgcatcatctttctgtatgccaatgggaggtgaaacttaagttggacagcgatgggcctgccagtggtacctggagagttgtaacaaccaatgttactagtcacacctgcactgtggatatctaccgtgaggttgaagatacagaatcacagaaactagtataccactctgctccatcgtcatctggtcctttgcatggcgttgcactgaatactccatatcagcctttgagtgttattgatctgaaacgttgctccgctagaaacaacagaactacatactgctatgattttccgttggcatttgaaactgcagtgcagaagtcatggtctaacatttctagtgacaataaccgatgttatgttaaagcaacggagctggtgtttgctcacaagaatgggtcatggggcactcctgtaattcctatggagcgtcctgctgggctcaatgacattggtatggtagcttggatcttggacatgtccactcctgaatatcccaatggcaggcagattgttgtcatcgcaaatgatattacttttagagctggatcgtttggtccaagggaagatgcattttttgaaactgttaccaacctagcttgtgagaggaggcttcctctcatctacttggcagcaaactctggtgctcggatcggcatagcagatgaagtaaaatcttgcttccgtgttggatggtctgatgatggcagccctgaacgtgggtttcaatatatttatctgactgaagaagaccatgctcgtattagcgcttctgttatagcgcacaagatgcagcttgataatggtgaaattaggtgggttattgattctgttgtagggaaggaggatgggctaggtgtggagaacatacatggaagtgctgctattgccagtgcctattctagggcctatgaggagacatttacgcttacatttgtgactggaaggactgttggaataggagcatatcttgctcgacttggcatacggtgcattcagcgtactgaccagcccattatcctaactgggttttctgccttgaacaagcttcttggccgggaagtgtacagctcccacatgcagttgggtggccccaaaattatggcgacaaacggtgttgtccatctgacagtttcagatgaccttgaaggtgtatctaatatattgaggtggctcagctatgttcctgccaacattggtggacctcttcctattacaaaatctttggacccacctgacagacccgttgcttacatccctgagaatacatgcgatcctcgtgctgccatcagtggcattgatgatagccaagggaaatggttggggggcatgttcgacaaagacagttttgtggagacatttgaaggatgggcgaagtcagttgttactggcagagcgaaactcggagggattccggtgggtgttatagctgtggagacacagactatgatgcagctcatccctgctgatccaggccagcttgattcccatgagcgatctgttcctcgtgctgggcaagtctggtttccagattcagctactaagacagcgcaggcaatgctggacttcaaccgtgaaggattacctctgttcatccttgctaactggagaggcttctctggtggacaaagagatctttttgaaggaatccttcaggctgggtcaacaattgttgagaaccttagggcatacaatcagcctgcctttgtatatatccccaaggctgcagagctacgtggaggggcttgggtcgtgattgatagcaagataaatccagatcgcattgagttctatgctgagaggactgcaaagggcaatgttctcgaacctcaagggttgatcgagatcaagttcaggtcagaggaactccaagagtgcatgggtaggcttgatccagaattgataaatctgaaggcaaagctccagggagtaaagcatgaaaatggaagtctacctgagtcagaatcccttcagaagagcatagaagcccggaagaaacagttgttgcctttgtatactcaaattgcggtacggttcgctgaattgcatgacacttcccttagaatggctgctaagggtgtgattaagaaggttgtagactgggaagattctaggtcgttcttctacaagagattacggaggaggatatccgaggatgttcttgcgaaggaaattagaggtgtaagtggcaagcagttttctcaccaatcggcaatcgagctgatccagaaatggtacttggcctctaagggagctgaaacaggaagcactgaatgggatgatgacgatgcttttgttgcctggagggaaaaccctgaaaactaccaggagtatatcaaagaacccagggctcaaagggtatctcagttgctctcagatgttgcagactccagtccagatctagaagccttgccacagggtctttctatgctactagagaagatggatcctgcaaagagggaaattgttgaagactttgaaataaaccttgtaaagtaa

SEQ ID NO: 55 - protein, 2235 aa, Saccharomyces cerevisiae
MEFSEESLFESSPQKMEYEITNYSERHTELPGHFIGLNTVDKLEESPLRDFVKSHGGHTVISKILIANNGIAAVKEIRSVRKWAYETFGDDRTVQFVAMATPEDLEANAEYIRMADQYIEVPGGTNNNNYANVDLIVDIAERADVDAVWAGWGHASENPLLPEKLSQSKRKVIFIGPPGNAMRSLGDKISSTIVAQSAKVPCIPWSGTGVDTVHVDEKTGLVSVDDDIYQKGCCTSPEDGLQKAKRIGFPVMIKASEGGGGKGIRQVEREEDFIALYHQAANEIPGSPIFIMKLAGRARHLEVQLLADQYGTNISLFGRDCSVQRRHQKIIEEAPVTIAKAETFHEMEKAAVRLGKLVGYVSAGTVEYLYSHDDGKFYFLELNPRLQVEHPTTEMVSGVNLPAAQLQIAMGIPMHRISDIRTLYGMNPHSASEIDFEFKTQDATKKQRRPIPKGHCTACRITSEDPNDGFKPSGGTLHELNFRSSSNVWGYFSVGNNGNIHSFSDSQFGHIFAFGENRQASRKHMVVALKELSIRGDFRTTVEYLIKLLETEDFEDNTITTGWLDDLITHKMTAEKPDPTLAVICGAATKAFLASEEARHKYIESLQKGQVLSKDLLQTMFPVDFIHEGKRYKFTVAKSGNDRYTLFINGSKCDIILRQLSDGGLLIAIGGKSHTIYWKEEVAATRLSVDSMTTLLEVENDPTQLRTPSPGKLVKFLVENGEHIIKGQPYAEIEVMKMQMPLVSQENGIVQLLKQPGSTIVAGDIMAIMTLDDPSKVKHALPFEGMLPDFGSPVIEGTKPAYKFKSLVSTLENILKGYDNQVIMNASLQQLIEVLRNPKLPYSEWKLHISALHSRLPAKLDEQMEELVARSLRRGAVFPARQLSKLIDMAVKNPEYNPDKLLGAVVEPLADIAHKYSNGLEAHEHSIFVHFLEEYYEVEKLFNGPNVREENIILKLRDENPKDLDKVALTVLSHSKVSAKNNLILAILKHYQPLCKLSSKVSAIFSTPLQHIVELESKATAKVALQAREILIQGALPSVKERTEQIEHILKSSVVKVAYGSSNPKRSEPDLNILKDLIDSNYVVFDVLLQFLTHQDPVVTAAAAQVYIRRAYRAYTIGDIRVHEGVTVPIVEWKFQLPSAAFSTFPTVKSKMGMNRAVSVSDLSYVANSQSSPLREGILMAVDHLDDVDEILSQSLEVIPRHQSSSNGPAPDRSGSSASLSNVANVCVASTEGFESEEEILVRLREILDLNKQELINASIRRITFMFGFKDGSYPKYYTFNGPNYNENETIRHIEPALAFQLELGRLSNFNIKPIFTDNRNIHVYEAVSKTSPLDKRFFTRGIIRTGHIRDDISIQEYLTSEANRLMSDILDNLEVTDTSNSDLNHIFINFIAVFDISPEDVEAAFGGFLERFGKRLLRLRVSSAEIRIIIKDPQTGAPVPLRALINNVSGYVIKTEMYTEVKNAKGEWVFKSLGKPGSMHLRPIATPYPVKEWLQPKRYKAHLMGTTYVYDFPELFRQASSSQWKNFSADVKLTDDFFISNELIEDENGELTEVEREPGANAIGMVAFKITVKTPEYPRGRQFVVVANDITFKIGSFGPQEDEFFNKVTEYARKRGIPRIYLAANSGARIGMAEEIVPLFQVAWNDAANPDKGFQYLYLTSEGMETLKKFDKENSVLTERTVINGEERFVIKTIIGSEDGLGVECLRGSGLIAGATSRAYHDIFTITLVTCRSVGIGAYLVRLGQRAIQVEGQPIILTGAPAINKMLGREVYTSNLQLGGTQIMYNNGVSHLTAVDDLAGVEKIVEWMSYVPAKRNMPVPILETKDTWDRPVDFTPTNDETYDVRWMIEGRETESGFEYGLFDKGSFFETLSGWAKGVVVGRARLGGIPLGVIGVETRTVENLIPADPANPNSAETLIQEPGQVWHPNSAFKTAQAINDFNNGEQLPMMILANWRGFSGGQRDMFNEVLKYGSFIVDALVDYKQPIIIYIPPTGELRGGSWVVVDPTINADQMEMYADVNARAGVLEPQGMVGIKFRREKLLDTMNRLDDKYRELRSQLSNKSLAPEVHQQISKQLADRERELLPIYGQISLQFADLHDRSSRMVAKGVISKELEWTEARRFFFWRLRRRLNEEYLIKRLSHQVGEASRLEKIARIRSWYPASVDHEDDRQVATWIEENYKTLDDKLKGLKLESFAQDLAKKIRSDHDNAIDGLSEVIKMLSTDDKEKLLKTLK

SEQ ID NO: 56 - DNA, 6708 bp, Artificial Sequence
  Codon-optimized S. cerevisiae acetyl Coa carboxylase (ACC1)
atggaattctccgaggaaagtttgttcgaaagcagtccgcagaaaatggaatatgaaattacgaattattcggaacgccacacggagctccccgggcacttcatcggactcaacaccgtggataagctcgaagaaagtcccctccgcgattttgtgaaaagccacggcggccataccgtgatctcgaagattctgattgccaataacggaattgccgctgtcaaggagatccgcagcgtccggaagtgggcgtacgaaacttttggcgatgaccgtacagtccagtttgttgctatggcgactccggaagacttggaggcgaatgcggaatacattcgaatggccgatcaatacatcgaagtccccggaggaacgaacaacaacaattatgcgaacgtcgatttgatcgtggatatcgcagaacgcgcggacgtggatgctgtttgggccggatggggccacgcttcggaaaaccctctgttgccggaaaaactcagccagtctaaacggaaagtcattttcatcggccctccgggcaacgcaatgcgctcgttgggtgataagatcagctcgaccattgtggctcagagcgctaaagtcccatgtattccctggtcgggtaccggcgtggatacggtccatgttgatgagaaaactggactggtcagcgtcgatgatgatatctaccaaaagggctgttgcaccagcccggaagatggcctgcaaaaggcgaagcgcatcgggttcccagtcatgatcaaggcatccgaaggcggaggcggtaagggtatccgccaggttgagcgtgaagaagattttatcgcactgtatcatcaagcggctaacgaaatcccgggctcgccaattttcattatgaaactggctggtcgggcgcgtcatctcgaagtgcaactcctcgctgaccagtacggtacgaacatctctttgttcggtcgggattgttcggtccagcgtcgtcaccagaagatcattgaagaagcccctgttaccatcgcaaaggccgagacgtttcatgagatggagaaagcggccgtccgcctcggcaagctggtcggttacgttagcgcaggcaccgtggaatacctctattcccacgacgatggtaagttttactttctcgaactgaatcctcgcctgcaggttgaacacccgaccacagagatggtgtcgggggtcaatctgccggctgcgcagttgcagattgcaatgggcattccgatgcatcgaatcagcgacatccgaaccctgtacggcatgaacccgcacagtgcgagcgaaatcgactttgagttcaagacccaagacgccacgaagaaacagcgacgcccaattccgaagggccattgcaccgcgtgtcgcattacctcggaggaccccaatgatggttttaagccctcgggcggtactctgcacgagctcaacttccgctcctcctcgaacgtctggggctatttcagcgtcggaaataatggtaacattcatagtttttccgattcccaatttggccatatcttcgcctttggcgaaaaccgacaagctagccgcaaacacatggtcgtggcgttgaaggagctgagtatccgaggggactttcgcacgacggtggaatatctgatcaaactgctcgaaacggaggactttgaggataacacaattaccaccggatggttggacgacctgattacgcacaaaatgaccgccgagaaacccgaccccaccttggcagtgatttgtggcgcggcaacgaaggcctttttggcctctgaagaggcacgccacaagtacattgagagtctccaaaagggtcaggtgctgagtaaagatctgctgcaaaccatgtttcctgtcgactttattcatgaggggaaacgctacaaattcacggttgctaagtctggtaatgatcggtacacattgtttatcaatggatcgaagtgcgatattatcttgcgacaactctccgacggcggcctcctgattgctatcggcgggaaaagtcataccatctattggaaagaagaggtcgccgccacccgactgagcgttgattcgatgactactctgctcgaagttgaaaacgatccaacgcaactgcgcactccctctccgggtaagctcgtgaagtttctcgtcgagaatggcgaacacattattaagggccagccgtatgcggaaatcgaggtgatgaagatgcagatgcccctggtcagccaagagaacggtattgtgcaactgctgaaacagcccggcagcaccatcgtcgctggcgatatcatggctatcatgaccctcgatgatccttccaaagtcaaacatgccctgcccttcgaaggcatgctccccgattttggctcccccgtgattgagggcaccaaaccagcttacaagtttaaatcgctggtttccaccctcgagaacatcttgaagggctacgataatcaggtcattatgaatgccagcctccagcagctcattgaggtcctccgtaaccccaagctgccctacagtgaatggaagctccacatcagtgcgctccactcgcgactgcccgcgaagctcgatgagcagatggaagagctcgtcgctcgcagcctgcgtcgcggcgcagtctttccggcacggcaactgtcgaagctcatcgatatggctgtcaaaaaccccgaatacaaccccgataaactcttgggtgctgtcgttgagccgctcgccgatatcgcgcacaagtacagtaatggcctggaggcgcacgaacacagtatctttgttcacttcctggaagaatactatgaggttgagaaactgttcaatgggcctaatgtccgggaagagaatattatcctgaagctccgtgatgaaaatccgaaagatttggataaagtcgccttgacggtgctcagtcatagcaaggtgagtgccaagaacaatctcatcctggcgatcttgaaacactaccaacctttgtgcaagctgagttccaaggtgtcggctatttttagtacgcccctgcagcacatcgtggaactcgaaagtaaagccaccgccaaggtggctctgcaggcccgggagattctgatccagggtgctctgccgagcgtgaaagagcggacggaacaaatcgaacacatcctgaagagttcggtcgtgaaggttgcatatggcagcagtaaccctaaacgctcggaaccggacctcaatatcctgaaggatctgatcgatagtaattatgttgtttttgatgtcctgctccaatttctgactcaccaagatccggttgttactgcggctgccgcgcaagtttacattcgacgcgcctatcgcgcctacacaatcggcgatattcgagtccatgagggcgtgaccgttccaatcgttgaatggaaattccagttgccatcggcggctttttctacattcccaacagtcaagagtaagatgggcatgaatcgtgccgtttcggtcagtgatttgtcctatgtcgcaaactcgcaatctagtcctctgcgagagggcatcctgatggcagtggatcatttggatgatgtcgatgagatcctctcgcaaagtctcgaggtcattcctcgccaccaatcgtcgtccaatggcccagctcccgatcgatccggttcttccgccagcttgtcgaatgtcgccaacgtctgtgtggcgtcgactgaggggttcgaaagcgaagaagaaattttggtccgcttgcgggaaattttggacctcaacaagcaggaactgattaatgcctctattcgccgcattacgtttatgttcggtttcaaggatggctcgtacccaaaatactatacgttcaacggcccgaactacaatgagaacgagactatccgacatattgaacctgccctcgctttccaactggaactggggcggctctcgaatttcaatattaagcctatttttaccgacaaccgtaacatccacgtttacgaggctgtcagcaaaacaagcccgctggataagcgattcttcacccggggcattatccgcacaggccacatccgtgacgatatcagtatccaagaatacctgactagcgaagctaaccgcttgatgagcgacattttggataatctggaagtgactgatacttccaacagcgacttgaatcacatttttatcaacttcattgccgtgttcgatatctcgccggaagatgtggaagccgcgtttggaggctttctggaacggtttggcaaacggctgctgcgcttgcgggtgtctagcgcggagattcggattatcatcaaagatccgcaaacgggggctcctgtgccactgcgcgcgctgattaataacgtctcgggttacgtgatcaagaccgagatgtacacagaggttaaaaacgctaaaggcgagtgggtcttcaagagcttgggcaaacccggcagcatgcatctccgccccatcgccacgccgtatccggtcaaggagtggctgcagcccaagcgatacaaggcgcacttgatggggacgacatatgtttacgattttcctgaactgttccgtcaagcaagcagctcccagtggaaaaacttttccgcagatgtgaaattgactgatgatttcttcatctcgaatgagctcatcgaagatgagaatggcgagctgaccgaagttgagcgagaacctggtgccaatgcgattgggatggtcgcctttaaaatcacggtcaaaactcccgagtaccctcggggtcgccagttcgtcgttgtggctaacgatatcacctttaagattggatcgtttggcccgcaggaggatgagttctttaacaaggtcactgaatacgcccgaaaacgaggcattccgcggatttacttggcagccaatagcggtgcgcgcatcggcatggctgaagaaatcgttccgctgtttcaggttgcctggaacgacgcggccaaccccgacaaggggttccagtacttgtatctgacttccgaaggcatggagacgttgaagaaatttgataaggagaatagtgtcttgactgagcggaccgttattaacggcgaggagcggtttgtcattaagactatcatcggcagcgaagatggcctcggcgtcgaatgtttgcgcgggtccggcctgatcgcaggggcaacctcgcgagcctatcacgatatctttaccattactttggtcacgtgtcgttcggttggcattggagcatacctcgtgcgcctcggtcagcgcgccatccaagtggaaggccaacctatcattttgactggcgcgcctgctatcaataagatgctgggccgtgaagtctacacatcgaacctccaactgggcggtacccaaattatgtataacaatggcgtcagccatctgacagccgtcgatgacctggctggcgttgaaaagattgttgagtggatgagctatgtgcccgccaaacggaacatgccagtccccattttggaaaccaaggatacctgggatcgcccagtggatttcactccgactaatgatgaaacctacgatgtccgctggatgatcgaagggcgcgaaactgagtcgggcttcgagtacggactgtttgataagggtagtttctttgagactctcagtggttgggccaaaggcgttgtcgtcggtcgggcacgtctgggcggcatcccgctgggagttattggtgttgagacacgtacggtggaaaatctgatcccggctgatccggccaaccccaatagtgcggaaacgctgattcaagagcccgggcaagtgtggcacccgaatagtgcctttaagacggcgcaggctattaatgattttaacaacggcgaacaactgcctatgatgattctggcgaattggcgggggtttagtggtgggcagcgcgacatgttcaacgaagtgctcaagtacggctccttcatcgtggacgccctggtcgactataaacaaccaattatcatctatattccccctaccggcgagctgcgaggcggtagctgggtcgtggtggaccctactattaatgcagatcaaatggagatgtacgccgacgtgaatgctcgagcgggcgtgctggaaccacaagggatggttggcatcaaattccgccgcgaaaaactgttggatactatgaatcgactggatgataaatatcgcgagctgcgcagccaactgtcgaacaagtctctggccccggaagtccatcaacagatttctaaacagctggcagatcgcgaacgtgaactcttgccgatctacggccaaatcagcctccaatttgccgacctgcatgatcgcagcagccgcatggttgcgaaaggtgtcatcagcaaagagctcgagtggacggaagctcggcggtttttcttttggcggctgcgccgacgcctgaatgaagaatacttgattaagcgtctgagccaccaggtcggcgaggctagtcggttggaaaagatcgcccgcattcggagttggtatccggcatcggttgaccacgaggacgatcgccaggtcgctacctggatcgaagagaactacaaaaccttggatgataagctgaaaggactgaagctggagtctttcgcccaagatctcgccaagaagatccgtagcgatcatgacaatgcaatcgacggtttgagcgaggttatcaagatgttgtctaccgacgacaaggagaagctgctcaaaacgctgaagtag

SEQ ID NO: 57 - DNA, 6702 bp, Artificial Sequence
  Synthetic construct Saccharomyces cerevisiae clone FLH148869.01X ACC1
atgagcgaagaaagcttattcgagtcttctccacagaagatggagtacgaaattacaaactactcagaaagacatacagaacttccaggtcatttcattggcctcaatacagtagataaactagaggagtccccgttaagggactttgttaagagtcacggtggtcacacggtcatatccaagatcctgatagcaaataatggtattgccgccgtgaaagaaattagatccgtcagaaaatgggcatacgagacgttcggcgatgacagaaccgtccaattcgtcgccatggccaccccagaagatctggaggccaacgcagaatatatccgtatggccgatcaatacattgaagtgccaggtggtactaataataacaactacgctaacgtagacttgatcgtagacatcgccgaaagagcagacgtagacgccgtatgggctggctggggtcacgcctccgagaatccactattgcctgaaaaattgtcccagtctaagaggaaagtcatctttattgggcctccaggtaacgccatgaggtctttaggtgataaaatctcctctaccattgtcgctcaaagtgctaaagtcccatgtattccatggtctggtaccggtgttgacaccgttcacgtggacgagaaaaccggtctggtctctgtcgacgatgacatctatcaaaagggttgttgtacctctcctgaagatggtttacaaaaggccaagcgtattggttttcctgtcatgattaaggcatccgaaggtggtggtggtaaaggtatcagacaagttgaacgtgaagaagatttcatcgctttataccaccaggcagccaacgaaattccaggctcccccattttcatcatgaagttggccggtagagcgcgtcacttggaagttcaactgctagcagatcagtacggtacaaatatttccttgttcggtagagactgttccgttcagagacgtcatcaaaaaattatcgaagaagcaccagttacaattgccaaggctgaaacatttcacgagatggaaaaggctgccgtcagactggggaaactagtcggttatgtctctgccggtaccgtggagtatctatattctcatgatgatggaaaattctactttttagaattgaacccaagattacaagtcgagcatccaacaacggaaatggtctccggtgttaacttacctgcagctcaattacaaatcgctatgggtatccctatgcatagaataagtgacattagaactttatatggtatgaatcctcattctgcctcagaaatcgatttcgaattcaaaactcaagatgccaccaagaaacaaagaagacctattccaaagggtcattgtaccgcttgtcgtatcacatcagaagatccaaacgatggattcaagccatcgggtggtactttgcatgaactaaacttccgttcttcctctaatgtttggggttacttctccgtgggtaacaatggtaatattcactccttttcggactctcagttcggccatatttttgcttttggtgaaaatagacaagcttccaggaaacacatggttgttgccctgaaggaattgtccattaggggtgatttcagaactactgtggaatacttgatcaaacttttggaaactgaagatttcgaggataacactattaccaccggttggttggacgatttgattactcataaaatgaccgctgaaaagcctgatccaactcttgccgtcatttgcggtgccgctacaaaggctttcttagcatctgaagaagcccgccacaagtatatcgaatccttacaaaagggacaagttctatctaaagacctactgcaaactatgttccctgtagattttatccatgagggtaaaagatacaagttcaccgtagctaaatccggtaatgaccgttacacattatttatcaatggttctaaatgtgatatcatactgcgtcaactatctgatggtggtcttttgattgccataggcggtaaatcgcataccatctattggaaagaagaagttgctgctacaagattatccgttgactctatgactactttgttggaagttgaaaacgatccaacccagttgcgtactccatcccctggtaaattggttaaattcttggtggaaaatggtgaacacattatcaagggccaaccatatgcagaaattgaagttatgaaaatgcaaatgcctttggtttctcaagaaaatggtatcgtccagttattaaagcaacctggttctaccattgttgcaggtgatatcatggctattatgactcttgacgatccatccaaggtcaagcacgctctaccatttgaaggtatgctgccagattttggttctccagttatcgaaggaaccaaacctgcctataaattcaagtcattagtgtctactttggaaaacattttgaagggttatgacaaccaagttattatgaacgcttccttgcaacaattgatagaggttttgagaaatccaaaactgccttactcagaatggaaactacacatctctgctttacattcaagattgcctgctaagctagatgaacaaatggaagagttagttgcacgttctttgagacgtggtgctgttttcccagctagacaattaagtaaattgattgatatggccgtgaagaatcctgaatacaaccccgacaaattgctgggcgccgtcgtggaaccattggcggatattgctcataagtactctaacgggttagaagcccatgaacattctatatttgtccatttcttggaagaatattacgaagttgaaaagttattcaatggtccaaatgttcgtgaggaaaatatcattctgaaattgcgtgatgaaaaccctaaagatctagataaagttgcgctaactgttttgtctcattcgaaagtttcagcgaagaataacctgatcctagctatcttgaaacattatcaaccattgtgcaagttatcttctaaagtttctgccattttctctactcctctacaacatattgttgaactagaatctaaggctaccgctaaggtcgctctacaagcaagagaaattttgattcaaggcgctttaccttcggtcaaggaaagaactgaacaaattgaacatatcttaaaatcctctgttgtgaaggttgcctatggctcatccaatccaaagcgctctgaaccagatttgaatatcttgaaggacttgatcgattctaattacgttgtgttcgatgttttacttcaattcctaacccatcaagacccagttgtgactgctgcagctgctcaagtctatattcgtcgtgcttatcgtgcttacaccataggagatattagagttcacgaaggtgtcacagttccaattgttgaatggaaattccaactaccttcagctgcgttctccacctttccaactgttaaatctaaaatgggtatgaacagggctgtttctgtttcagatttgtcatatgttgcaaacagtcagtcatctccgttaagagaaggtattttgatggctgtggatcatttagatgatgttgatgaaattttgtcacaaagtttggaagttattcctcgtcaccaatcttcttctaacggacctgctcctgatcgttctggtagctccgcatcgttgagtaatgttgctaatgtttgtgttgcttctacagaaggtttcgaatctgaagaggaaattttggtaaggttgagagaaattttggatttgaataagcaggaattaatcaatgcttctatccgtcgtatcacatttatgttcggttttaaagatgggtcttatccaaagtattatacttttaacggtccaaattataacgaaaatgaaacaattcgtcacattgagccggctttggccttccaactggaattaggaagattgtccaacttcaacattaaaccaattttcactgataatagaaacatccatgtctacgaagctgttagtaagacttctccattggataagagattctttacaagaggtattattagaacgggtcatatccgtgatgacatttctattcaagaatatctgacttctgaagctaacagattgatgagtgatatattggataatttagaagtcaccgacacttcaaattctgatttgaatcatatcttcatcaacttcattgcggtgtttgatatctctccagaagatgtcgaagccgccttcggtggtttcttagaaagatttggtaagagattgttgagattgcgtgtttcttctgccgaaattagaatcatcatcaaagatcctcaaacaggtgccccagtaccattgcgtgccttgatcaataacgtttctggttatgttatcaaaacagaaatgtacaccgaagtcaagaacgcaaaaggtgaatgggtatttaagtctttgggtaaacctggatccatgcatttaagacctattgctactccttaccctgttaaggaatggttgcaaccaaaacgttataaggcacacttgatgggtaccacatatgtctatgacttcccagaattattccgccaagcatcgtcatcccaatggaaaaatttctctgcagatgttaagttaacagatgatttctttatttccaacgagttgattgaagatgaaaacggcgaattaactgaggtggaaagagaacctggtgccaacgctattggtatggttgcctttaagattactgtaaagactcctgaatatccaagaggccgtcaatttgttgttgttgctaacgatatcacattcaagatcggttcctttggtccacaagaagacgaattcttcaataaggttactgaatatgctagaaagcgtggtatcccaagaatttacttggctgcaaactcaggtgccagaattggtatggctgaagagattgttccactatttcaagttgcatggaatgatgctgccaatccggacaagggcttccaatacttatacttaacaagtgaaggtatggaaactttaaagaaatttgacaaagaaaattctgttctcactgaacgtactgttataaacggtgaagaaagatttgtcatcaagacaattattggttctgaagatgggttaggtgtcgaatgtctacgtggatctggtttaattgctggtgcaacgtcaagggcttaccacgatatcttcactatcaccttagtcacttgtagatccgtcggtatcggtgcttatttggttcgtttgggtcaaagagctattcaggtcgaaggccagccaattattttaactggtgctcctgcaatcaacaaaatgctgggtagagaagtttatacttctaacttacaattgggtggtactcaaatcatgtataacaacggtgtttcacatttgactgctgttgacgatttagctggtgtagagaagattgttgaatggatgtcttatgttccagccaagcgtaatatgccagttcctatcttggaaactaaagacacatgggatagaccagttgatttcactccaactaatgatgaaacttacgatgtaagatggatgattgaaggtcgtgagactgaaagtggatttgaatatggtttgtttgataaagggtctttctttgaaactttgtcaggatgggccaaaggtgttgtcgttggtagagcccgtcttggtggtattccactgggtgttattggtgttgaaacaagaactgtcgagaacttgattcctgctgatccagctaatccaaatagtgctgaaacattaattcaagaacctggtcaagtttggcatccaaactccgccttcaagactgctcaagctatcaatgactttaacaacggtgaacaattgccaatgatgattttggccaactggagaggtttctctggtggtcaacgtgatatgttcaacgaagtcttgaagtatggttcgtttattgttgacgcattggtggattacaaacaaccaattattatctatatcccacctaccggtgaactaagaggtggttcatgggttgttgtcgatccaactatcaacgctgaccaaatggaaatgtatgccgacgtcaacgctagagctggtgttttggaaccacaaggtatggttggtatcaagttccgtagagaaaaattgctggacaccatgaacagattggatgacaagtacagagaattgagatctcaattatccaacaagagtttggctccagaagtacatcagcaaatatccaagcaattagctgatcgtgagagagaactattgccaatttacggacaaatcagtcttcaatttgctgatttgcacgataggtcttcacgtatggtggccaagggtgttatttctaaggaactggaatggaccgaggcacgtcgtttcttcttctggagattgagaagaagattgaacgaagaatatttgattaaaaggttgagccatcaggtaggcgaagcatcaagattagaaaagatcgcaagaattagatcgtggtaccctgcttcagtggaccatgaagatgataggcaagtcgcaacatggattgaagaaaactacaaaactttggacgataaactaaagggtttgaaattagagtcattcgctcaagacttagctaaaaagatcagaagcgaccatgacaatgctattgatggattatctgaagttatcaagatgttatctaccgatgataaagaaaaattgttgaagactttgaaatag

SEQ ID NO: 58 - protein, 458 aa, Acinetobacter baylii sp.
MRPLHPIDFIFLSLEKRQQPMHVGGLFLFQIPDNAPDTFIQDLVNDIRISKSIPVPPFNNKLNGLFWDEDEEFDLDHHFRHIALPHPGRIRELLIYISQEHSTLLDRAKPLWTCNIIEGIEGNRFAMYFKIHHAMVDGVAGMRLIEKSLSHDVTEKSIVPPWCVEGKRAKRLREPKTGKIKKIMSGIKSQLQATPTVIQELSQTVFKDIGRNPDHVSSFQAPCSILNQRVSSSRRFAAQSFDLDRFRNIAKSLNVTINDVVLAVCSGALRAYLMSHNSLPSKPLIAMVPASIRNDDSDVSNRITMILANLATHKDDPLQRLEIIRRSVQNSKQRFKRMTSDQILNYSAVVYGPAGLNIISGMMPKRQAFNLVISNVPGPREPLYWNGAKLDALYPASIVLDGQALNITMTSYLDKLEVGLIACRNALPRMQNLLTHLEEEIQLFEGVIAKQEDIKTAN

SEQ ID NO: 59 - protein, 446 aa, Streptomyces coelicolor
MTPDPLAPLDLAFWNIESAEHPMHLGALGVFEADSPTAGALAADLLAARAPAVPGLRMRIRDTWQPPMALRRPFAFGGATREPDPRFDPLDHVRLHAPATDFHARAGRLMERPLERGRPPWEAHVLPGADGGSFAVLFKFHHALADGLRALTLAAGVLDPMDLPAPRPRPEQPPRGLLPDVRALPDRLRGALSDAGRALDIGAAAALSTLDVRSSPALTAASSGTRRTAGVSVDLDDVHHVRKTTGGTVNDVLIAVVAGALRRWLDERGDGSEGVAPRALIPVSRRRPRSAHPQGNRLSGYLMRLPVGDPDPLARLGTVRAAMDRNKDAGPGRGAGAVALLADHVPALGHRLGGPLVSGAARLWFDLLVTSVPLPSLGLRLGGHPLTEVYPLAPLARGHSLAVAVSTYRGRVHYGLLADAKAVPDLDRLAVAVAEEVETLLTACRP

SEQ ID NO: 60 - protein, 457 aa, Alcanivorax borkumensis
MKALSPVDQLFLWLEKRQQPMHVGGLQLFSFPEGAGPKYVSELAQQMRDYCHPVAPFNQRLTRRLGQYYWTRDKQFDIDHHFRHEALPKPGRIRELLSLVSAEHSNLLDRERPMWEAHLIEGIRGRQFALYYKIHHSVMDGISAMRIASKTLSTDPSEREMAPAWAFNTKKRSRSLPSNPVDMASSMARLTASISKQAATVPGLAREVYKVTQKAKKDENYVSIFQAPDTILNNTITGSRRFAAQSFPLPRLKVIAKAYNCTINTVVLSMCGHALREYLISQHALPDEPLIAMVPMSLRQDDSTGGNQIGMILANLGTHICDPANRLRVIHDSVEEAKSRFSQMSPEEILNFTALTMAPTGLNLLTGLAPKWRAFNVVISNIPGPKEPLYWNGAQLQGVYPVSIALDRIALNITLTSYVDQMEFGLIACRRTLPSMQRLLDYLEQSIRELEIGAGIK

SEQ ID NO: 61 - protein, 460 aa, Acinetobacter baylii sp.
MEFRPLHPIDFIFLSLEKRQQPMHVGGLFLFQIPDNAPDTFIQDLVNDIRISKSIPVPPFNNKLNGLFWDEDEEFDLDHHFRHIALPHPGRIRELLIYISQEHSTLLDRAKPLWTCNIIEGIEGNRFAMYFKIHHAMVDGVAGMRLIEKSLSHDVTEKSIVPPWCVEGKRAKRLREPKTGKIKKIMSGIKSQLQATPTVIQELSQTVFKDIGRNPDHVSSFQAPCSILNQRVSSSRRFAAQSFDLDRFRNIAKSLNVTINDVVLAVCSGALRAYLMSHNSLPSKPLIAMVPASIRNDDSDVSNRITMILANLATHKDDPLQRLEIIRRSVQNSKQRFKRMTSDQILNYSAVVYGPAGLNIISGMMPKRQAFNLVISNVPGPREPLYWNGAKLDALYPASIVLDGQALNITMTSYLDKLEVGLIACRNALPRMQNLLTHLEEEIQLFEGVIAKQEDIKTAN

SEQ ID NO: 62 - DNA, 1377 bp, Artificial Sequence
  Codon-optimized Acinetobacter baylii sp. atfA
atgcggcccttgcaccccattgacttcatctttctgagtttggagaaacggcaacagcccatgcatgtcggtggcttgtttctcttccaaatccccgataacgccccggacacctttattcaggatctggtcaatgatatccggatctcgaaatcgatccccgtgccgccgtttaataataaactgaacggcctcttttgggacgaagacgaggaatttgatctggatcaccattttcggcacatcgctttgccccacccgggtcggattcgcgaactcctgatctatattagccaagaacacagcacgttgttggaccgggccaaaccgctctggacgtgcaatatcatcgaaggcatcgaaggcaaccgctttgcgatgtacttcaagattcatcacgcgatggttgacggtgtcgctggcatgcgcctgatcgaaaaatcgctgagccatgatgtgaccgaaaagagtatcgtccccccctggtgcgtggaaggtaagcgcgccaagcgcctccgcgaaccgaaaacgggcaagattaagaaaatcatgagcggtatcaagtcgcagctgcaggctaccccgaccgtgatccaggagctgtcgcaaaccgtgtttaaggatattggtcggaacccggatcatgtcagtagtttccaagctccctgttcgatcttgaatcagcgcgttagcagcagccgccggttcgctgctcaaagttttgatctcgatcggtttcggaatattgccaagtcgctgaacgtcaccatcaatgatgtggttctcgcggtttgttcgggtgccctccgcgcgtatctgatgagccataacagtctccccagtaagccgctgattgctatggttcccgcgtcgattcggaatgacgacagcgatgtgagcaaccggattaccatgatcctggctaacctcgcgacccacaaagatgatccgttgcaacgcctggagattatccgccgcagtgtgcagaacagtaaacagcgcttcaaacggatgaccagtgatcaaattctgaattacagcgctgtggtctatggtcccgccggcttgaatattatcagtggtatgatgcccaaacgccaagcgtttaacttggtgatcagtaatgtgccgggtccgcgcgaacccttgtattggaacggtgctaaactcgatgccctctaccccgccagtatcgtgctcgatggccaggctctcaatattaccatgaccagctatctcgataaactcgaggtgggtttgattgcgtgccgcaacgcgctgccccgcatgcagaacttgctgacccacctggaagaggaaatccagctcttcgagggcgtgattgcgaagcaggaagatattaaaacggccaactag

SEQ ID NO: 63 - DNA, 1376 bp, Acinetobacter sp.
atgcgcccattacatccgattgattttatattcctgtcactagaaaaaagacaacagcctatgcatgtaggtggtttatttttgtttcagattcctgataacgccccagacacctttattcaagatctggtgaatgatatccggatatcaaaatcaatccctgttccaccattcaacaataaactgaatgggcttttttgggatgaagatgaagagtttgatttagatcatcattttcgtcatattgcactgcctcatcctggtcgtattcgtgaattgcttatttatatttcacaagagcacagtacgctgctagatcgggcaaagcccttgtggacctgcaatattattgaaggaattgaaggcaatcgttttgccatgtacttcaaaattcaccatgcgatggtcgatggcgttgctggtatgcggttaattgaaaaatcactctcccatgatgtaacagaaaaaagtatcgtgccaccttggtgtgttgagggaaaacgtgcaaagcgcttaagagaacctaaaacaggtaaaattaagaaaatcatgtctggtattaagagtcagcttcaggcgacacccacagtcattcaagagctttctcagacagtatttaaagatattggacgtaatcctgatcatgtttcaagctttcaggcgccttgttctattttgaatcagcgtgtgagctcatcgcgacgttttgcagcacagtcttttgacctagatcgttttcgtaatattgccaaatcgttgaatgtgaccattaatgatgttgtactagcggtatgttctggtgcattacgtgcgtatttgatgagtcataatagtttgccttcaaaaccattaattgccatggttccagcctctattcgcaatgacgattcagatgtcagcaaccgtattacgatgattctggcaaatttggcaacccacaaagatgatcctttacaacgtcttgaaattatccgccgtagtgttcaaaactcaaagcaacgcttcaaacgtatgaccagcgatcagattctaaattatagtgctgtcgtatatggccctgcaggactcaacataatttctggcatgatgccaaaacgccaagccttcaatctggttatttccaatgtgcctggcccaagagagccactttactggaatggtgccaaacttgatgcactctacccagcttcaattgtattagacggtcaagcattgaatattacaatgaccagttatttagataaacttgaagttggtttgattgcatgccgtaatgcattgccaagaatgcagaatttactgacacatttagaagaagaaattcaactatttgaaggcgtaattgcaaagcaggaagatattaaaacagccaatta

SEQ ID NO: 64 - DNA, 1341 bp, Artificial Sequence
  Codon-optimized Streptomyces coelicolor DGAT
atgacgcctgacccgttggctcccttggacttggctttctggaatatcgaaagtgccgagcacccgatgcacttgggggcactgggggtctttgaggcggatagtccaaccgctggtgcactcgccgcggatctcctggctgcccgcgctcccgcagtgcccgggctgcgcatgcggattcgcgatacatggcagccgcctatggcgctccgtcgcccttttgcttttggcggtgctacacgcgagcccgacccgcggtttgatccactcgatcatgtgcggctccatgccccagcgacggatttccacgcacgcgcaggtcggttgatggagcgccctctggaacgaggccgtcctccttgggaagcccatgtcctgccaggggctgacggtggatcgtttgcggtcttgtttaagttccatcatgccctggccgacggtctgcgggcgctgacgctggcggcgggcgtgctcgatccgatggatctccccgctccacggccccgcccagagcagcccccccgtggtctcctgccggatgtccgcgcgctgccggatcggctgcgaggggctctgtctgacgcgggccgcgcgttggacatcggcgccgccgcagccctcagcaccctggatgtgcggagcagtcccgctctgactgcggcgtcctcgggcacgcgacgtaccgccggcgtgtccgtggatctcgacgacgtgcaccatgttcgcaaaacgacaggcggtaccgttaacgatgttttgatcgccgttgttgccggggccctgcgacgctggctggatgaacgaggcgatgggtcggaaggcgtcgccccgcgcgccctcattcccgtcagccggcggcgacctcggagcgcacacccgcaaggcaaccgattgagtggctacctgatgcgcttgccggtcggcgacccggaccctctcgcacggttgggaaccgtccgtgccgcgatggatcgaaataaggatgcggggcccggccgcggagctggcgcagttgctctcttggcagaccacgttcctgccctgggccaccgcctgggtggacccctcgtctcgggcgctgctcgactgtggttcgatctgttggtcacgagcgtcccgttgccctctttgggtttgcgcctcggtgggcatccgctgaccgaagtgtacccactggcccccctggcccgtggccactccttggcggtggcggtgagcacttatcgcggtcgggttcattacggtctcctcgctgatgctaaagccgttcctgatctggatcgtctggcagtggccgtcgccgaggaggttgaaaccttgctcactgcgtgccgcccctag

SEQ ID NO: 65 - DNA, 1374 bp, Artificial Sequence
  Codon-optimized Alcanivorax borkumensis DGAT
atgaaagctttgagccccgttgatcagctgtttctgtggttggaaaaacggcagcaacccatgcatgtgggtgggttgcagctgttctcctttcccgaaggcgcggggccgaaatatgtctcggaactggcccaacagatgcgcgattattgtcaccctgtcgccccgttcaaccaacgtctgacacggcgcctggggcaatactactggacacgtgataagcaatttgacattgaccatcattttcggcacgaggccctgcccaaaccgggtcggattcgcgagttgctcagcttggtgagtgcggaacactccaacttgttggatcgtgaacgacccatgtgggaagcgcacctgatcgaaggaatccgcgggcgccaatttgccttgtattacaaaattcatcactccgtcatggacggtatctccgctatgcggattgcctctaagaccttgtccacggaccccagtgagcgggagatggcccccgcttgggcgtttaatactaagaagcgatcgcgcagcctgccaagcaatcccgtggatatggcgagctcgatggctcgactcactgcaagtatttcgaaacaagctgccaccgtgcccggcctggcacgagaggtctacaaggtgacccaaaaagctaaaaaggatgaaaattacgttagtattttccaagcaccagacaccatcctcaataatacgattacgggcagtcgacgcttcgccgctcagtcgttccctctcccccgtctgaaggttatcgctaaggcttacaactgcactattaacacggttgtgctctcgatgtgcggccacgccctgcgcgaatacctcatcagtcaacatgccctgccggatgaacccctgatcgcgatggtccctatgagcctgcgccaagatgatagcaccggaggcaaccagatcggaatgattttggcgaatctgggcacgcatatctgcgatcctgccaatcgcctgcgtgtcatccatgatagcgtggaggaggcgaaaagccgttttagccaaatgtctccggaggagattctgaactttacagcactcactatggcgccgaccggtctgaacttgctcaccggtttggctcccaaatggcgcgcatttaacgtcgttatctctaacatcccagggccaaaggaaccactgtactggaatggggcacagctccagggtgtgtatccggtctccatcgccttggatcggattgccctgaacattacactgacgtcttatgttgatcagatggagttcggcttgattgcgtgtcgccggaccctcccgtcgatgcaacgactcctcgactatctcgaacagagtatccgcgaactggagattggcgcgggcatcaaatag

SEQ ID NO: 66 - DNA, 1383 bp, Artificial Sequence
  Codon-optimized Acinetobacter baylii sp. DGATd
atggaattccggcccttgcaccccattgacttcatctttctgagtttggagaaacggcaacagcccatgcatgtcggtggcttgtttctcttccaaatccccgataacgccccggacacctttattcaggatctggtcaatgatatccggatctcgaaatcgatccccgtgccgccgtttaataataaactgaacggcctcttttgggacgaagacgaggaatttgatctggatcaccattttcggcacatcgctttgccccacccgggtcggattcgcgaactcctgatctatattagccaagaacacagcacgttgttggaccgggccaaaccgctctggacgtgcaatatcatcgaaggcatcgaaggcaaccgctttgcgatgtacttcaagattcatcacgcgatggttgacggtgtcgctggcatgcgcctgatcgaaaaatcgctgagccatgatgtgaccgaaaagagtatcgtccccccctggtgcgtggaaggtaagcgcgccaagcgcctccgcgaaccgaaaacgggcaagattaagaaaatcatgagcggtatcaagtcgcagctgcaggctaccccgaccgtgatccaggagctgtcgcaaaccgtgtttaaggatattggtcggaacccggatcatgtcagtagtttccaagctccctgttcgatcttgaatcagcgcgttagcagcagccgccggttcgctgctcaaagttttgatctcgatcggtttcggaatattgccaagtcgctgaacgtcaccatcaatgatgtggttctcgcggtttgttcgggtgccctccgcgcgtatctgatgagccataacagtctccccagtaagccgctgattgctatggttcccgcgtcgattcggaatgacgacagcgatgtgagcaaccggattaccatgatcctggctaacctcgcgacccacaaagatgatccgttgcaacgcctggagattatccgccgcagtgtgcagaacagtaaacagcgcttcaaacggatgaccagtgatcaaattctgaattacagcgctgtggtctatggtcccgccggcttgaatattatcagtggtatgatgcccaaacgccaagcgtttaacttggtgatcagtaatgtgccgggtccgcgcgaacccttgtattggaacggtgctaaactcgatgccctctaccccgccagtatcgtgctcgatggccaggctctcaatattaccatgaccagctatctcgataaactcgaggtgggtttgattgcgtgccgcaacgcgctgccccgcatgcagaacttgctgacccacctggaagaggaaatccagctcttcgagggcgtgattgcgaagcaggaagatattaaaacggccaactag

SEQ ID NO: 67 - DNA, 2535 bp, Synechococcus elongatus PCC 7942
atgagtgattccaccgcccaactcagctacgaccccaccacgagctacctcgagcccagtggcttggtctgtgaggatgaacggacttctgtgactcccgagaccttgaaacgggcttacgaggcccatctctactacagccagggcaaaacctcagcgatcgccaccctgcgtgatcactacatggcactggcctacatggtccgcgatcgcctcctgcaacggtggctagcttcactgtcgacctatcaacaacagcacgtcaaagtggtctgttacctgtccgctgagtttttgatgggtcggcacctcgaaaactgcctgatcaacctgcatcttcacgaccgcgttcagcaagttttggatgaactgggtctcgattttgagcaactgctagagaaagaggaagaacccgggctaggcaacggtggcctcggtcgcctcgcagcttgtttcctcgactccatggctaccctcgacattcctgccgtcggctatggcattcgctatgagttcggtatcttccaccaagaactccacaacggctggcagatcgaaatccccgataactggctgcgctttggcaacccttgggagctagagcggcgcgaacaggccgtggaaattaagttgggcggccacacggaggcctaccacgatgcgcgaggccgctactgcgtctcttggatccccgatcgcgtcattcgcgccatcccctacgacacccccgtaccgggctacgacaccaataacgtcagcatgttgcggctctggaaggctgagggcaccacggaactcaaccttgaggctttcaactcaggcaactacgacgatgcggttgccgacaaaatgtcgtcggaaacgatctcgaaggtgctctatcccaacgacaacaccccccaagggcgggaactgcggctggagcagcagtatttcttcgtctcggcttcgctccaagacatcatccgtcgccacttgatgaaccacggtcatcttgagcggctgcatgaggcgatcgcagtccagcttaacgacacccatcccagcgtggcggtgccggagttgatgcgcctcctgatcgatgagcatcacctgacttgggacaatgcttggacgattacacagcgcaccttcgcctacaccaaccacacgctgctacctgaagccttggaacgctggcccgtgggcatgttccagcgcactttaccgcgcttgatggagattatctacgaaatcaactggcgcttcttggccaatgtgcgggcctggtatcccggtgacgacacgagagctcgccgcctctccctgattgaggaaggagctgagccccaggtgcgcatggctcacctcgcctgcgtgggcagtcatgccatcaacggtgtggcagccctgcatacgcaactgctcaagcaagaaaccctgcgagatttctacgagctttggcccgagaaattcttcaacatgaccaacggtgtgacgccccgccgctggctgctgcaaagtaatcctcgcctagccaacctgatcagcgatcgcattggcaatgactggattcatgatctcaggcaactgcgacggctggaagacagcgtgaacgatcgcgagtttttacagcgctgggcagaggtcaagcaccaaaataaggtcgatctgagccgctacatctaccagcagactcgcatagaagtcgatccgcactctctctttgatgtgcaagtcaaacggattcacgaatacaaacgccagctcctcgctgtcatgcatatcgtgacgctctacaactggctgaagcacaatccccagctcaacctggtgccgcgcacttttatctttgcgggcaaagcggccccgggttactaccgtgccaagcaaatcgtcaaactgatcaatgcggtcgggagcatcatcaaccatgatcccgatgtccaagggcgactgaaggtcgtcttcctacctaacttcaacgtttccttggggcagcgcatttatccagctgccgatttgtcggagcaaatctcaactgcagggaaagaagcgtccggcaccggcaacatgaagttcaccatgaatggcgcgctgacaatcggaacctacgatggtgccaacatcgagatccgcgaggaagtcggccccgaaaacttcttcctgtttggcctgcgagccgaagatatcgcccgacgccaaagtcggggctatcgacctgtggagttctggagcagcaatgcggaactgcgggcagtcctcgatcgctttagcagtggtcacttcacaccggatcagcccaacctcttccaagacttggtcagcgatctgctgcagcgggatgagtacatgttgatggcggactatcagtcctacatcgactgccagcgcgaagctgctgctgcctaccgcgattccgatcgctggtggcggatgtcgctactcaacaccgcgagatcgggcaagttctcctccgatcgcacgatcgctgactacagcgaacagatctgggaggtcaaaccagtccccgtcagcctaagcactagcttttag

SEQ ID NO: 68 - protein, 844 aa, Synechococcus elongatus PCC 7942
MSDSTAQLSYDPTTSYLEPSGLVCEDERTSVTPETLKRAYEAHLYYSQGKTSAIATLRDHYMALAYMVRDRLLQRWLASLSTYQQQHVKVVCYLSAEFLMGRHLENCLINLHLHDRVQQVLDELGLDFEQLLEKEEEPGLGNGGLGRLAACFLDSMATLDIPAVGYGIRYEFGIFHQELHNGWQIEIPDNWLRFGNPWELERREQAVEIKLGGHTEAYHDARGRYCVSWIPDRVIRAIPYDTPVPGYDTNNVSMLRLWKAEGTTELNLEAFNSGNYDDAVADKMSSETISKVLYPNDNTPQGRELRLEQQYFFVSASLQDIIRRHLMNHGHLERLHEAIAVQLNDTHPSVAVPELMRLLIDEHHLTWDNAWTITQRTFAYTNHTLLPEALERWPVGMFQRTLPRLMEIIYEINWRFLANVRAWYPGDDTRARRLSLIEEGAEPQVRMAHLACVGSHAINGVAALHTQLLKQETLRDFYELWPEKFFNMTNGVTPRRWLLQSNPRLANLISDRIGNDWIHDLRQLRRLEDSVNDREFLQRWAEVKHQNKVDLSRYIYQQTRIEVDPHSLFDVQVKRIHEYKRQLLAVMHIVTLYNWLKHNPQLNLVPRTFIFAGKAAPGYYRAKQIVKLINAVGSIINHDPDVQGRLKVVFLPNFNVSLGQRIYPAADLSEQISTAGKEASGTGNMKFTMNGALTIGTYDGANIEIREEVGPENFFLFGLRAEDIARRQSRGYRPVEFWSSNAELRAVLDRFSSGHFTPDQPNLFQDLVSDLLQRDEYMLMADYQSYIDCQREAAAAYRDSDRWWRMSLLNTARSGKFSSDRTIADYSEQIWEVKPVPVSLSTSF

SEQ ID NO: 69 - DNA, 2085 bp, Synechococcus elongatus PCC 7942
atgactgtttcatcccgtcgccctgaatcgaccgtggctgttgaccccggccaaagctatcccctcggggcaaccgtctatcccaccggcgtcaacttctcgctctacaccaagtacgcgacgggcgttgaattactgctgtttgatgaccctgagggtgcccagcctcaacggacagtgcgcctcgatccgcacctcaatcgcacctctttctactggcatgtttttattccgggcattcgctccggtcaggtttatgcttaccgcgtctttggcccctacgcacctgatcgcggcctctgttttaaccccaacaaagtgctgctggatccctacgctcgcggggttgtcggctggcagcactacagtcgcgaagcggctattaaacccagtaataactgcgttcaagccctgcgtagcgtggttgttgaccccagcgactacgactgggaaggcgatcgccatccacgcacaccctacgctcgcacagtaatctatgagctgcatgttggcggcttcaccaagcatcccaattccggcgtcgcccctgaaaaacgtggcacctacgctggtctaatcgaaaaaattccctacctgcaatccctcggcgtcacggccgttgagttgctgccggtgcaccagttcgatcgccaagatgcccccttaggacgcgagaactactggggctacagcaccatggctttttttgcgccccacgcagcctacagctctcgccatgatccacttggtccagttgatgagttccgcgacctcgtcaaggcgctccaccaagcagggattgaggtgattctcgacgtggtgttcaaccacactgctgaagggaatgaagacggtccaacgctgtctttcaaaggtctagcgaattcaacctactatctgctggatgaacaggcgggctatcgcaactacaccggctgcggcaacaccgtcaaagctaacaattcgatcgtgcgatcgctgattctcgattgcctgcgttattgggtctcggaaatgcacgtcgatggcttccgctttgaccttgcgtcggtgctgagtcgtgatgccaatggcaaccccctatcggatccgcccttgctttgggcgattgattccgatccggttttggccggtacgaagctcattgctgaagcttgggacgcagccggcttatatcaggttggtacctttattggcgatcgctttgggacttggaacggtcccttccgggacgatattcggcgtttttggcgtggagatcagggctgtacttacgccctcagtcaacgcctgctgggtagccccgatgtctacagcacagaccaatggtatgccggacgcaccattaacttcatcacctgccatgacggctttacgctgcgagatctagtcagctatagccagaagcacaactttgccaatggagagaacaatcgggacgggaccaatgacaactacagctggaactacggcattgaaggcgagaccgatgaccccacgattctgagcttacgggaacggcagcagcgcaatttgctcgccacgttattcctcgcccagggcacaccgatgctgacgatgggcgatgaggtcaaacgcagtcagcagggtaacaataacgcctactgccaagacaatgagatcagctggtttgattggtcgctgtgcgatcgccatgccgatttcttggtgttcagtcgccgcctgattgaactttcccagtcgctggtgatgttccaacagaacgaactgctgcagaacgaaccccatccgcgtcgtccctatgccatctggcatggcgtcaaactcaaacaacccgattgggcgctgtggtcccacagtctggccgtcagtctctgccatcctcgccagcaggaatggctttacctagcctttaatgcttactgggaagacctgcgcttccagttgccgaggcctcctcgcggccgcgtttggtatcgcttgctcgatacttcactgccgaatcttgaagcttgtcatctgccggatgaggcaaaaccctgcctacggcgcgattacatcgtcccagcgcgatcgctcttactgttgatggctcgtgcttaa

SEQ ID NO: 70 - protein, 694 aa, Synechococcus elongatus PCC 7942
MTVSSRRPESTVAVDPGQSYPLGATVYPTGVNFSLYTKYATGVELLLFDDPEGAQPQRTVRLDPHLNRTSFYWHVFIPGIRSGQVYAYRVFGPYAPDRGLCFNPNKVLLDPYARGVVGWQHYSREAAIKPSNNCVQALRSVVVDPSDYDWEGDRHPRTPYARTVIYELHVGGFTKHPNSGVAPEKRGTYAGLIEKIPYLQSLGVTAVELLPVHQFDRQDAPLGRENYWGYSTMAFFAPHAAYSSRHDPLGPVDEFRDLVKALHQAGIEVILDVVFNHTAEGNEDGPTLSFKGLANSTYYLLDEQAGYRNYTGCGNTVKANNSIVRSLILDCLRYWVSEMHVDGFRFDLASVLSRDANGNPLSDPPLLWAIDSDPVLAGTKLIAEAWDAAGLYQVGTFIGDRFGTWNGPFRDDIRRFWRGDQGCTYALSQRLLGSPDVYSTDQWYAGRTINFITCHDGFTLRDLVSYSQKHNFANGENNRDGTNDNYSWNYGIEGETDDPTILSLRERQQRNLLATLFLAQGTPMLTMGDEVKRSQQGNNNAYCQDNEISWFDWSLCDRHADFLVFSRRLIELSQSLVMFQQNELLQNEPHPRRPYAIWHGVKLKQPDWALWSHSLAVSLCHPRQQEWLYLAFNAYWEDLRFQLPRPPRGRVWYRLLDTSLPNLEACHLPDEAKPCLRRDYIVPARSLLLLMARA

SEQ ID NO: 71 - DNA, 1500 bp, Synechococcus elongatus PCC 7942
gtgtttacacgagccgccggcattttgttacatcccacttcgttgccggggccattcggcagcggcgaccttggtccggcctcgcggcagtttcttgactggttggcaacggcgggacaacaactgtggcaagtgttgccccttgggccgacaggctatggctattcgccttacctctgctattccgccttggctggcaatcccgctctgatcagccctgaactcttggcagaagatggctggctccaagaatcggactgggcagactgtcctgcttttccgagcgatcgcgtcgattttgccagcgtcttgccctatcgcgatcaactgctgcgccgtgcctacagccaattcctgcaaagagcggcttccagcgatcgccaactctttcaagctttctgtgaacaggaagcccattggctggatgactacgccctgttcatggcgattaagctggctagccaaggtcagccttggacagaatggccggaagcgctgcgtcagcggcaacctcaagccttggctaaagcccgcgatcgctggggcggcgaaattggcttccagcagtttctgcagtggcaatttcgcgagcagtggttggccctgcgggaagaagcccaagcccgccatatttcgctgattggcgatattccgatctacgtcgctcatgacagtgcggacgtttgggccaatcctcagttctttgccctcgatcctgaaacgggcgcagttgatcagcaggccggtgtgccgcctgactatttctccgaaaccggccaactctggggcaatcccgtctacaactgggctgcgctgcaggcggatggctatcgctggtggttgcaacggctgcaacagctcctcagcttagtggactacattcgcatcgaccacttccgcggtttagaggcgttttggtcggttcccgctggtgaagaaacggcgatcgacggagagtgggtcaaagccccaggcgctgatctgctgagcacgattcgccaaaaactgggagcgctaccgattctggcagaggatctcggtgtgattacgccggaggtggaagcgctgcgcgatcgctttgagctgccgggcatgaagattctgcagttcgcctttgactctggggccggcaatgcctatctaccgcacaactactggggtcgtcgctgggtggcttacaccggcacccacgacaatgacacgaccgtcggctggttcctgtcccgcaatgacagcgatcgccaaacggtgctggattatctgggcgcagagtcgggctgggaaattgagtggaagctgatccgcttggcttggagctcgacggcagattgggcgatcgcaccgctccaagatgtcttcgggctggatagcagcgcccgcatgaatcgaccggggcaagccaccggcaactgggactggcgcttcagtgccgactggctgacgggcgatcgtgcccaacgcctgcggcgactctcgcagctctatggacgctgtagatga

SEQ ID NO: 72 - protein, 499 aa, Synechococcus elongatus PCC 7942
MFTRAAGILLHPTSLPGPFGSGDLGPASRQFLDWLATAGQQLWQVLPLGPTGYGYSPYLCYSALAGNPALISPELLAEDGWLQESDWADCPAFPSDRVDFASVLPYRDQLLRRAYSQFLQRAASSDRQLFQAFCEQEAHWLDDYALFMAIKLASQGQPWTEWPEALRQRQPQALAKARDRWGGEIGFQQFLQWQFREQWLALREEAQARHISLIGDIPIYVAHDSADVWANPQFFALDPETGAVDQQAGVPPDYFSETGQLWGNPVYNWAALQADGYRWWLQRLQQLLSLVDYIRIDHFRGLEAFWSVPAGEETAIDGEWVKAPGADLLSTIRQKLGALPILAEDLGVITPEVEALRDRFELPGMKILQFAFDSGAGNAYLPHNYWGRRWVAYTGTHDNDTTVGWFLSRNDSDRQTVLDYLGAESGWEIEWKLIRLAWSSTADWAIAPLQDVFGLDSSARMNRPGQATGNWDWRFSADWLTGDRAQRLRRLSQLYGRCR

SEQ ID NO: 73 - protein, 543 aa, Synechococcus elongatus PCC 7942
MNIHTVATQAFSDQKPGTSGLRKQVPVFQKRHYLENFVQSIFDSLEGYQGQTLVLGGDGRYYNRTAIQTILKMAAANGWGRVLVGQGGILSTPAVSNLIRQNGAFGGIILSASHNPGGPEGDFGIKYNISNGGPAPEKVTDAIYACSLKIEAYRILEAGDVDLDRLGSQQLGEMTVEVIDSVADYSRLMQSLFDFDRIRDRLRGGLRIAIDSMHAVTGPYATTIFEKELGAAAGTVFNGKPLEDFGGGHPDPNLVYAHDLVELLFGDRAPDFGAASDGDGDRNMILGNHFFVTPSDSLAILAANASLVPAYRNGLSGIARSMPTSAAADRVAQALNLPCYETPTGWKFFGNLLDADRVTLCGEESFGTGSNHVREKDGLWAVLFWLNILAVREQSVAEIVQEHWRTYGRNYYSRHDYEGVESDRASTLVDKLRSQLPSLTGQKLGAYTVAYADDFRYEDPVDGSISEQQGIRIGFEDGSRMVFRLSGTGTAGATLRLYLERFEGDTTKQGLDPQVALADLIAIADEVAQITTLTGFDQPTVIT

SEQ ID NO: 74 - protein, 567 aa, Synechocystis sp. PCC 6803
MSKPLIAALHFLQFLYMTSRINPLAGQHPPADSLLDVAKLLDDYYRQQPDPENPAQLVSFGTSGHRGSALNGTFNEAHILAVTQAVVDYRQAQGITGPLYMGMDSHALSEPAQKTALEVLAANQVETFLTTATDLTRFTPTPAVSYAILTHNQGRKEGLADGIIITPSHNPPTDGGFKYNPPSGGPAEPEATQWIQNRANELLKNGNKTVKRLDYEQALKATTTHAHDFVTPYVAGLADIIDLDVIRSAGLRLGVDPLGGANVGYWEPIAAKYNLNISLVNPGVDPTFKFMTLDWDGKIRMDCSSPYAMASLVKIKDHYDIAFGNDTDGDRHGIVTPSVGLMNPNHFLSVAIWYLFSQRQQWSGLSAIGKTLVSSSMIDRVGAMINRQVYEVPVGFKWFVSGLLDGSFGFGGEESAGASFLKKNGTVWTTDKDGTIMDLLAAEITAKTGKDPGLHYQDLTAKLGNPIYQRIDAPATPAQKDRLKKLSPDDVTATSLAGDAITAKLTKAPGNQAAIGGLKVTTAEGWFAARPSGTENVYKIYAESFKDEAHLQAIFTEAEAIVTSALG

SEQ ID NO: 75 - DNA, 1632 bp, Synechococcus elongatus PCC 7942; identical to SEQ ID NO: 24

SEQ ID NO: 76 - protein, 543 aa, Synechococcus elongatus PCC 7942; identical to SEQ ID NO: 73

SEQ ID NO: 77 - protein, 552 aa, Synechococcus sp. WH8102
MTTSAPAEPTLRLVRLDAPFTDQKPGTSGLRKSSQQFEQANYLESFVEAVFRTLPGVQGGTLVLGGDGRYGNRRAIDVILRMGAAHGLSKVIVTTGGILSTPAASNLIRQRQAIGGIILSASHNPGGPNGDFGVKVNGANGGPTPASFTDAVFECTKTLEQYTIVDAAAIAIDTPGSYSIGAMQVEVIDGVDDFVALMQQLFDFDRIRELIRSDFPLAFDAMHAVTGPYATRLLEEILGAPAGSVRNGVPLEDFGGGHPDPNLTYAHELAELLLDGEEFRFGAACDGDGDRNMILGQHCFVNPSDSLAVLTANATVAPAYADGLAGVARSMPTSSAVDVVAKELGIDCYETPTGWKFFGNLLDAGKITLCGEESFGTGSNHVREKDGLWAVLFWLQILAERRCSVAEIMAEHWKRFGRHYYSRHDYEAVASDAAHGLFHRLEGMLPGLVGQSFAGRSVSAADNFSYTDPVDGSVTKGQGLRILLEDGSRVMVRLSGTGTKGATIRVYLESYVPSSGDLNQDPQVALADMISAINELAEIKQRTGMDRPTVIT

SEQ ID NO: 78 - DNA, 1662 bp, Synechococcus sp. RCC 307
gtgacgctttcctcacccagcactgagttctccgtgcagcagatcaagctgccagaagcgtttcaagaccagaagcctggcacctcgggactgcgcaagagcacccaacaatttgaacagcctcattacctcgaaagttttatcgaggcgatcttccgcaccctccctggtgtgcaaggcgggaccttggtggtgggcggtgatggccgctacggcaaccgccgcgccatcgatgtcatcacccggatggcggcagcccatggactggggcggattgtgctgaccaccggcggcatcctctccacccctgccgcttccaacttgatccgccaacgccaggccattggcggcatcatcctctcggccagccacaaccctggagggcccaaaggcgactttggcgtcaaggtcaatggcgccaacggcggccctgcccctgaatctcttaccgatgccatctacgcctgcagccagcagctcgatggctaccgcatcgcaagtggaaccgcactgcccctcgacgccccagccgagcatcaaatcggtgcgttgaacgtggaggtgatcgacggcgtcgacgactacctgcaactgatgcagcacttgttcgacttcgatctgatcagcgatttgctcaagggctcatggccaatggcctttgacgccatgcatgccgtcactggtccctacgccagcaaactctttgagcagctcctaggagccccaagcgggaccgtgcgcaacgggcgctgcctcgaagactttggtggcggccatcccgatcccaacctcacctacgccaaagagctggcgacgctgctgctggatggtgatgactatcgctttggcgcggcctgtgatggcgatggcgaccgcaacatgattttggggcagcgctgctttgtgaaccccagcgacagcctcgctgtcttaacggcgaacgccaccttggtgaagggctatgcctccggcctggccggcgttgctcgctcgatgcccaccagtgccgcagtggatgtggtggccaagcagctggggatcaattgctttgagacccccaccggttggaaatttttcggcaacctgctcgatgccggacgcatcaccctttgcggggaagagagctttggaacaggcagtgatcacatccgcgaaaaagatggcctctgggctgtgttgttttggctctcgatcctggccaagcgccaatgctctgttgcggaggtgatgcagcagcactggagcacctacgggcgtcattactactcgcgccatgactacgaaggtgtcgaaaccgatcgggcccatgggctctacaacggcctgcgcgatcggcttggcgagctgactggaaccagctttgccgatagccgcatcgccaatgctgacgacttcgcctacagcgaccccgtcgatggctcactgacccagaagcaaggcctacgtctgctcctggaggacggcagccgcatcatcctgcggctctcgggaaccggcaccaaaggagccacgctgcggctctatctcgagcgctatgtcgccactggcggcaacctcgatcaaaatccccagcaagccttagccggcatgattgcggccgccgatgccctcgccggcatccggtcaaccaccggcatggatgtccccacggtgatcacctga

SEQ ID NO: 79 - protein, 553 aa, Synechococcus sp. RCC 307
MTLSSPSTEFSVQQIKLPEAFQDQKPGTSGLRKSTQQFEQPHYLESFIEAIFRTLPGVQGGTLVVGGDGRYGNRRAIDVITRMAAAHGLGRIVLTTGGILSTPAASNLIRQRQAIGGIILSASHNPGGPKGDFGVKVNGANGGPAPESLTDAIYACSQQLDGYRIASGTALPLDAPAEHQIGALNVEVIDGVDDYLQLMQHLFDFDLISDLLKGSWPMAFDAMHAVTGPYASKLFEQLLGAPSGTVRNGRCLEDFGGGHPDPNLTYAKELATLLLDGDDYRFGAACDGDGDRNMILGQRCFVNPSDSLAVLTANATLVKGYASGLAGVARSMPTSAAVDVVAKQLGINCFETPTGWKFFGNLLDAGRITLCGEESFGTGSDHIREKDGLWAVLFWLSILAKRQCSVAEVMQQHWSTYGRHYYSRHDYEGVETDRAHGLYNGLRDRLGELTGTSFADSRIANADDFAYSDPVDGSLTQKQGLRLLLEDGSRIILRLSGTGTKGATLRLYLERYVATGGNLDQNPQQALAGMIAAADALAGIRSTTGMDVPTVIT

SEQ ID NO: 80 - DNA, 1467 bp, Synechococcus sp PCC 7002
gtgttggcgtttgggaatcaacagccgattcggttcggcacagacggttggcgtggcattattgcggcggattttacctttgaacgggtgcaacgggtggcgatcgccacagcccatgttttaaaagaaaatttcgcaaaccaagccattgataacacgataatcgtcggctacgaccggcggtttctcgcagatgaatttgcccttgctgccgccgaagcgatccagggggaaggatttcacgtacttctagccaatagttttgcgccaaccccagccctgagctatgccgcccaccaccacaaggctctgggggcgatcgccttaacggccagccataatccagcgggttatttaggattaaaagtgaaaggggctttcggcggctcggtttccgaagaaattacggctcagattgaagcgcgactggaagccgggattgatcctcaacattcaacgacgggccgtttagattattttgatccctggcaggactattgcgccggattacagcaactggttgatttagaaaaaattcgccaggcgatcgccgctggtcgtctccaggtctttgccgatgtaatgtatggcgcagcggcgggcggtttgacccaactgctcaatgcggcgatccaagaaatccattgtgaaccagatcctttgttcggcggccgcccaccagagcctttagaaaaacatttgtctcaactgcaacgcaccattcgcgccgcccataatcaagatttagaggcaattcaggtgggatttgtctttgatggtgatggcgatcgcattgctgctgtggctggggatggtgagtttctcagttcccaaaagctaatcccgattttgctggcccatttgtcccaaaatcgccaatatcaaggggaagtggtaaaaactgtcagcggctctgatttaatcccccgtttgagcgaatactacggtttgccagtctttgaaacacccatcggctacaaatacattgccgaacgaatgcaacagacccaggtgcttcttggtggcgaagaatccggcggcattggctacggccaccacattcccgaacgggatgcgctgctggcggcattgtatctcctagaggcgatcgccatttttgatcaagacctcggcgagatttaccagagtcttcaaagcaaagctaatttttatggcgcctacgaccgcattgatttacatttgcgggatttctccagccgcgatcgcctattaaaaatcctcgcgacaaatccccccaaggcgatctccaaccatgacgtaattcacagcgaccccaaagatggctataaattccgccttgctgatcaaagttggttgctgattcgcttcagtggtaccgagcctgtactgcggttatatagtgaagcggtcaatcctaaagccgtacaagaaatcctcgcctgggcgcaaacctgggctgaggctgccgaccaagccgaaggttag

SEQ ID NO: 81 - protein, 488 aa, Synechococcus sp PCC 7002
MLAFGNQQPIRFGTDGWRGIIAADFTFERVQRVAIATAHVLKENFANQAIDNTIIVGYDRRFLADEFALAAAEAIQGEGFHVLLANSFAPTPALSYAAHHHKALGAIALTASHNPAGYLGLKVKGAFGGSVSEEITAQIEARLEAGIDPQHSTTGRLDYFDPWQDYCAGLQQLVDLEKIRQAIAAGRLQVFADVMYGAAAGGLTQLLNAAIQEIHCEPDPLFGGRPPEPLEKHLSQLQRTIRAAHNQDLEAIQVGFVFDGDGDRIAAVAGDGEFLSSQKLIPILLAHLSQNRQYQGEVVKTVSGSDLIPRLSEYYGLPVFETPIGYKYIAERMQQTQVLLGGEESGGIGYGHHIPERDALLAALYLLEAIAIFDQDLGEIYQSLQSKANFYGAYDRIDLHLRDFSSRDRLLKILATNPPKAISNHDVIHSDPKDGYKFRLADQSWLLIRFSGTEPVLRLYSEAVNPKAVQEILAWAQTWAEAADQAEG

SEQ ID NO: 82 - DNA, 1038 bp, Synechococcus elongatus PCC 7942
atgaccttgctattggccggggatatcggcggaaccaaaacgaatttaatgttggcgatcgcctctgattgcgatcgtttagaaccgctccatcaggccagttttgccagtgcggcctaccctgatttagtgccgatggtgcaggagtttttggctgccgcaccctccgccgaggtgcgatcgccagttgtggcttgttttggcattgccggccccgttgtccatggaaccgcgaagctgacgaacctgccttggcagctctctgaagcgcggctggcgaaggaattgggcattgcgcaggtggcgttgatcaatgattttgctgcgatcgcctacggcctacccggcttgaccgccgaagatcaagtcgttgtgcaagtcggtgaagccgatccggcggctccgatcgccattctgggggcaggaactggcttgggcgaaggcttcatcattcccacagcccaaggccgccaagtgtttggcagcgaaggttctcacgctgactttgcgccgcaaaccgaactggagtccgagttactgcattttctacgcaatttttacgcaatcgagcatatctcggtcgagcgagtggtctccggccaagggattgcagccatctacgccttcctgcgcgatcgccatcccgaccaagaaaatccagcccttggggcgattgcctcggcttggcaaacgggcggcgaccaagcccctgatctggcagcagccgtatcccaagcagccttgagcgatcgcgatccgctggccctacaagccatgcagatatttgtcagtgcttacggggcggaagccggcaacctcgcgttgaaattgctctcctacggcggggtctacgtcgccggcgggattgcgggcaaaatcctgccgctcttgactgatggcacttttctgcaagccttccaagccaagggacgggtgaaggggctgctgacgcggatgcctatcacgatcgtcacgaaccacgaagtcgggctgatcggggctggactgcgggcggctgcgatcgctactcaaccatga

SEQ ID NO: 83 - protein, 345 aa, Synechococcus elongatus PCC 7942
MTLLLAGDIGGTKTNLMLAIASDCDRLEPLHQASFASAAYPDLVPMVQEFLAAAPSAEVRSPVVACFGIAGPVVHGTAKLTNLPWQLSEARLAKELGIAQVALINDFAAIAYGLPGLTAEDQVVVQVGEADPAAPIAILGAGTGLGEGFIIPTAQGRQVFGSEGSHADFAPQTELESELLHFLRNFYAIEHISVERVVSGQGIAAIYAFLRDRHPDQENPALGAIASAWQTGGDQAPDLAAAVSQAALSDRDPLALQAMQIFVSAYGAEAGNLALKLLSYGGVYVAGGIAGKILPLLTDGTFLQAFQAKGRVKGLLTRMPITIVTNHEVGLIGAGLRAAAIATQP

SEQ ID NO: 84 - DNA, 1587 bp, Synechococcus elongatus PCC 7942
atgaccgcccagcagctctggcaacgctacctcgattggctctactacgatccctcgctggagttttacctcgacatcagccgcatgggattcgatgacgctttcgttactagcatgcagcccaagttccagcacgcctttgcggcgatggcagagctcgaggccggagcgatcgccaaccccgatgaacagcggatggtcggccactactggctgcgcgatcctgagctggcacccacaccggagctgcagacccaaattcgcgacacgctggccgcgatccaagacttcgccctcaaagtacacagtggcgtgttgcggccacccaccggctcccgcttcaccgacattctctcaattggcattggcgggtcggccctagggccgcagtttgtctcagaagccctccggcctcaagcggcactgctccagattcacttctttgacaacaccgatccagctggcttcgatcgcgttttagctgatctcggcgatcgccttgcttccaccttagtaatcgttatttccaaatctggcggcactcccgaaacccgcaacggcatgctggaggttcagtccgcctttgcccagcgagggattgcctttgcgccccaagctgtcgccgtcacaggggtggggagccatctcgatcatgtagcgatcacagaaagatggctggcccgtttccccatggaagactgggtgggcggccgcacctctgaactatctgcagtcggtctactctcggcagccctactgggcatcgacatcaccgccatgctggccggggcgcggcaaatggacgccctgacccgccattccgatttgcgacaaaatccggcagcgctcttggctttgagctggtactgggccggcaatgggcaaggcaaaaaagacatggtcatcctgccctacaaggacagcctgctgctgtttagccgctatctgcagcagttgatcatggagtcactgggcaaggagcgcgatctgctcggcaaggtagttcaccaaggcatcgccgtttacggcaacaaaggctcgaccgatcaacatgcctacgtccagcaactgcgcgagggcattcctaacttctttgccacgtttatcgaggtgctcgaagaccgacaggggccgtcgccagtcgtggagcctggcatcaccagtggcgactatctcagcgggctgcttcaaggcacccgcgcggcgctttacgaaaatgggcgtgagtcgatcacgattacggtgccgcgcgttgatgcacaacaggtgggggccttgatcgcgctgtatgaacgggcggtgggactctatgccagcttggttggcatcaatgcctatcaccagccgggggtggaagccggcaaaaaggctgctgccggtgttctcgagatccagcgccagattgtggagttgctccaacagggacaaccactctcgatcgcagcgatcgcagacgatttaggtcagagtgagcagattgaaacgatctacaaaatcctgcgccatctcgaagccaatcaacgcggcgttcagttaaccggcgatcgccataatcccctcagtctgattgcgagttggcaacgataa

SEQ ID NO: 85 - protein, 528 aa, Synechococcus elongatus PCC 7942
MTAQQLWQRYLDWLYYDPSLEFYLDISRMGFDDAFVTSMQPKFQHAFAAMAELEAGAIANPDEQRMVGHYWLRDPELAPTPELQTQIRDTLAAIQDFALKVHSGVLRPPTGSRFTDILSIGIGGSALGPQFVSEALRPQAALLQIHFFDNTDPAGFDRVLADLGDRLASTLVIVISKSGGTPETRNGMLEVQSAFAQRGIAFAPQAVAVTGVGSHLDHVAITERWLARFPMEDWVGGRTSELSAVGLLSAALLGIDITAMLAGARQMDALTRHSDLRQNPAALLALSWYWAGNGQGKKDMVILPYKDSLLLFSRYLQQLIMESLGKERDLLGKVVHQGIAVYGNKGSTDQHAYVQQLREGIPNFFATFIEVLEDRQGPSPVVEPGITSGDYLSGLLQGTRAALYENGRESITITVPRVDAQQVGALIALYERAVGLYASLVGINAYHQPGVEAGKKAAAGVLEIQRQIVELLQQGQPLSIAAIADDLGQSEQIETIYKILRHLEANQRGVQLTGDRHNPLSLIASWQR

SEQ ID NO: 86 - protein, 439 aa, Synechocystis sp. PCC 6803
MCCWQSRGLLVKRVLAIILGGGAGTRLYPLTKLRAKPAVPLAGKYRLIDIPVSNCINSEIVKIYVLTQFNSASLNRHISRAYNFSGFQEGFVEVLAAQQTKDNPDWFQGTADAVRQYLWLFREWDVDEYLILSGDHLYRMDYAQFVKRHRETNADITLSVVPVDDRKAPELGLMKIDAQGRITDFSEKPQGEALRAMQVDTSVLGLSAEKAKLNPYIASMGIYVFKKEVLHNLLEKYEGATDFGKEIIPDSASDHNLQAYLFDDYWEDIGTIEAFYEANLALTKQPSPDFSFYNEKAPIYTRGRYLPPTKMLNSTVTESMIGEGCMIKQCRIHHSVLGIRSRIESDCTIEDTLVMGNDFYESSSERDTLKARGEIAAGIGSGTTIRRAIIDKNARIGKNVMIVNKENVQEANREELGFYIRNGIVVVIKNVTIADGTVI

SEQ ID NO: 87 - protein, 429 aa, Nostoc sp. PCC 7120
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKEALERTDFGKEIIPDAAKDHNVQAYLFDDYWEDIGTIEAFYNANLALTQQPMPPFSFYDEEAPIYTRARYLPPTKLLDCHVTESIIGEGCILKNCRIQHSVLGVRSRIETGCMIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 88 - protein, 429 aa, Anabaena variabilis
MKKVLAIILGGGAGTRLYPLTKLRAKPAVPVAGKYRLIDIPVSNCINSEIFKIYVLTQFNSASLNRHIARTYNFSGFSEGFVEVLAAQQTPENPNWFQGTADAVRQYLWMLQEWDVDEFLILSGDHLYRMDYRLFIQRHRETNADITLSVIPIDDRRASDFGLMKIDNSGRVIDFSEKPKGEALTKMRVDTTVLGLTPEQAASQPYIASMGIYVFKKDVLIKLLKESLERTDFGKEIIPDASKDHNVQAYLFDDYWEDIGTIEAFYNANLALTQQPMPPFSFYDEEAPIYTRARYLPPTKLLDCHVTESIIGEGCILKNCRIQHSVLGVRSRIETGCVIEESLLMGADFYQASVERQCSIDKGDIPVGIGPDTIIRRAIIDKNARIGHDVKIINKDNVQEADRESQGFYIRSGIVVVLKNAVITDGTII

SEQ ID NO: 89 - protein, 428 aa, Trichodesmium erythraeum IMS 101
MKNVLSIILGGGAGTRLYPLTKLRAKPAVPLAGKYRLIDIPISNCINSEIQKIYVLTQFNSASLNRHITRTYNFSGFSDGFVEVLAAQQTKDNPEWFQGTADAVRKYIWLFKEWDIDYYLILSGDHLYRMDYRDFVQRHIDTKADITLSVLPIDEARASEFGVMKIDNSGRIVEFSEKPKGNALKAMAVDTSILGVSPEIATKQPYIASMGIYVFNKDAMIKLIEDSEDTDFGKEILPKSAQSYNLQAYPFQGYWEDIGTIKSFYEANLALTQQPQPPFSFYDEQAPIYTRSRYLPPSKLLDCEITESIVGEGCILKKCRIDHCVLGVRSRIEANCIIQDSLLMGSDFYESPTERRYGLKKGSVPLGIGAETKIRGAIIDKNARIGCNVQIINKDNVEEAQREEEGFIIRSGIVVVLKNATIPDGTVI

SEQ ID NO: 90 - protein, 430 aa, Synechococcus elongatus PCC 7942
MKNVLAIILGGGAGSRLYPLTKQRAKPAVPLAGKYRLIDIPVSNCINADINKIYVLTQFNSASLNRHLSQTYNLSSGFGNGFVEVLAAQITPENPNWFQGTADAVRQYLWLIKEWDVDEYLILSGDHLYRMDYSQFIQRHRDTNADITLSVLPIDEKRASDFGLMKLDGSGRVVEFSEKPKGDELRAMQVDTTILGLDPVAAAAQPFIASMGIYVFKRDVLIDLLSHHPEQTDFGKEVIPAAATRYNTQAFLFNDYWEDIGTIASFYEANLALTQQPSPPFSFYDEQAPIYTRARYLPPTKLLDCQVTQSIIGEGCILKQCTVQNSVLGIRSRIEADCVIQDALLMGADFYETSELRHQNRANGKVPMGIGSGSTIRRAIVDKNAHIGQNVQIVNKDHVEEADREDLGFMIRSGIVVVVKGAVIPDNTVI

SEQ ID NO: 91 - protein, 431 aa, Synechococcus sp. WH8102
MKRVLAIILGGGAGTRLYPLTKMRAKPAVPLAGKYRLIDIPISNCINSNINKMYVMTQFNSASLNRHLSQTFNLSASFGQGFVEVLAAQQTPDSPSWFEGTADAVRKYQWLFQEWDVDEYLILSGDQLYRMDYSLFVEHHRSTGADLTVAALPVDPKQAEAFGLMRTDGDGDIKEFREKPKGDSLLEMAVDTSRFGLSANSAKERPYLASMGIYVFSRDTLFDLLDSNPGYKDFGKEVIPEALKRGDKLKSYVFDDYWEDIGTIGAFYEANLALTQQPTPPFSFYDEKFPIYTRPRYLPPSKLVDAQITNSIVGEGSILKSCSIHHCVLGVRSRIETDVVLQDTLVMGADFFESSDERAVLRERGGIPVGVGQGTTVKRAILDKNARIGSNVTIVNKDHVEEADRSDQGFYIRNGIVVVVKNATIQDGTVI

SEQ ID NO: 92 - protein, 431 aa, Synechococcus sp. RCC 307
MKRVLAIILGGGAGTRLYPLTKMRAKPAVPLAGKYRLIDIPVSNCINSGINKIYVLTQFNSASLNRHIAQTFNLSSGFDQGFVEVLAAQQTPDSPSWFEGTADAVRKYEWLLQEWDIDEVLILSGDQLYRMDYAHFVAQHRASGADLTVAALPVDREQAQSFGLMHTGAEASITKFREKPKGEALDEMSCDTASMGLSAEEAHRRPFLASMGIYVFKRDVLFRLLAENPGATDFGKEIIPKALDDGFKLRSYLFDDYWEDIGTIRAFYEANLALTTQPRPPFSFYDKRFPIYTRHRYLPPSKLQDAQVTDSIVGEGSILKACSIHHCVLGVRSRIEDEVALQDTLVMGNDFYESGEERAILRERGGIPMGVGRGTTVKKAILDKNVRIGSNVSIINKDNVEEADRAEQGFYIRGGIVVITKNASIPDGMVI

SEQ ID NO: 93 - protein, 429 aa, Synechococcus sp. PCC 7002
MKRVLGIILGGGAGTRLYPLTKLRAKPAVPLAGKYRLIDIPVSNCINSEIHKIYILTQFNSASLNRHISRTYNFTGFTEGFTEVLAAQQTKENPDWFQGTADAVRQYSWLLEDWDVDEYIILSGDHLYRMDYREFIQRHRDTGADITLSVVPVGEKVAPAFGLMKIDANGRVVDFSEKPTGEALKAMQVDTQSLGLDPEQAKEKPYIASMGIYVFKKQVLLDLLKEGKDKTDFGKEIIPDAAKDYNVQAYLFDDYWADIGTIEAFYEANLGLTKQPIPPFSFYDEKAPIYTRARYLPPTKVLNADVTESMISEGCIIKNCRIHHSVLGIRTRVEADCTIEDTMIMGADYYQPYEKRQDCLRRGKPPIGIGEGTTIRRAIIDKNARIGKNVMIVNKENVEESNREELGYYIRSGITVVLKNAVIPDGTVI

SEQ ID NO: 94 - protein, 477 aa, Synechocystis sp. PCC 6803
MKILFVAAEVSPLAKVGGMGDVVGSLPKVLHQLGHDVRVFMPYYGFIGDKIDVPKEPVWKGEAMFQQFAVYQSYLPDTKIPLYLFGHPAFDSRRIYGGDDEAWRFTFFSNGAAEFAWNHWKPEIIHCHDWHTGMIPVWMHQSPDIATVFTIHNLAYQGPWRGLLETMTWCPWYMQGDNVMAAAIQFANRVTTVSPTYAQQIQTPAYGEKLEGLLSYLSGNLVGILNGIDTEIYNPAEDRFISNVFDADSLDKRVKNKIAIQEETGLEINRNAMVVGIVARLVEQKGIDLVIQILDRFMSYTDSQLIILGTGDRHYETQLWQMASRFPGRMAVQLLHNDALSRRVYAGADVFLMPSRFEPCGLSQLMAMRYGCIPIVRRTGGLVDTVSFYDPINEAGTGYCFDRYEPLDCFTAMVRAWEGFRFKADWQKLQQRAMRADFSWYRSAGEYIKVYKGVVGKPEELSPMEEEKIAELTASYR

SEQ ID NO: 95 - protein, 472 aa, Nostoc sp. PCC 7120
MRILFVAAEAAPIAKVGGMGDVVGALPKVLRKMGHDVRIFLPYYGFLPDKMEIPKDPIWKGYAMFQDFTVHEAVLPGTDVPLYLFGHPAFTPRRIYSGDDEDWRFTLFSNGAAEFCWNYWKPDIIHCHDWHTGMIPVWMNQSPDITTVFTIHNLAYQGPWRWYLDKITWCPWYMQGHNTMAAAVQFADRVNTVSPTYAEQIKTPAYGEKIEGLLSFISGKLSGIVNGIDTEVYDPANDKYIAQTFTADTLDKRKANKIALQEEVGLEVNSNAFLIGMVTRLVEQKGLDLVIQMLDRFMAYTDAQFVLLGTGDRYYETQMWQLASRYPGRMATYLLYNDALSRRIYAGTDAFLMPSRFEPCGISQMMALRYGSIPIVRRTGGLVDTVSHHDPINEAGTGYCFDRYEPLDLFTCMIRAWEGFRYKPQWQELQKRGMSQDFSWYKSAKEYDKLYRSMYGLPDPEETQPELILTNQ

SEQ ID NO: 96 - protein, 472 aa, Anabaena variabilis
MRILFVAAEAAPIAKVGGMGDVVGALPKVLRKMGHDVRIFLPYYGFLPDKMEIPKDPIWKGYAMFQDFTVHEAVLPGTDVPLYLFGHPAFNPRRIYSGDDEDWRFTLFSNGAAEFCWNYWKPEIIHCHDWHTGMIPVWMNQSPDITTVFTIHNLAYQGPWRWYLDKITWCPWYMQGHNTMAAAVQFADRVNTVSPTYAEQIKTPAYGEKIEGLLSFISGKLSGIVNGIDTEVYDPANDKFIAQTFTADTLDKRKANKIALQEEVGLEVNSNAFLIGMVTRLVEQKGLDLVIQMLDRFMAYTDAQFVLLGTGDRYYETQMWQLASRYPGRMATYLLYNDALSRRIYAGSDAFLMPSRFEPCGISQMMALRYGSIPIVRRTGGLVDTVSHHDPVNEAGTGYCFDRYEPLDLFTCMIRAWEGFRYKPQWQELQKRGMSQDFSWYKSAKEYDRLYRSIYGLPEAEETQPELILANQ

SEQ ID NO: 97 - protein, 460 aa, Trichodesmium erythraeum IMS 101
MRILFVSAEATPLAKVGGMADVVGALPKVLRKMGHDVRIFMPYYGFLGDKMEVPEEPIWEGTAMYQNFKIYETVLPKSDVPLYLFGHPAFWPRHIYYGDDEDWRFTLFANGAAEFCWNGWKPEIVHCNDWHTGMIPVWMHETPDIKTVFTIHNLAYQGPWRWYLERITWCPWYMEGHNTMAAAVQFADRVTTVSPTYASQIQTPAYGENLDGLMSFITGKLHGILNGIDMNFYNPANDRYIPQTYDVNTLEKRVDNKIALQEEVGFEVNKNSFLMGMVSRLVEQKGLDLMLQVLDRFMAYTDTQFILLGTGDRFYETQMWQIASRYPGRMSVQLLHNDALSRRIYAGTDAFLMPSRFEPCGISQLLAMRYGSIPIVRRTGGLVDTVSFYDPINNVGTGYSFDRYEPLDLLTAMVRAYEGFRFKDQWQELQKRGMRENFSWDKSAQGYIKMYKSMLGLPEE

SEQ ID NO: 98 - protein, 465 aa, Synechococcus elongatus PCC 7942
MRILFVAAECAPFAKVGGMGDVVGSLPKVLKALGHDVRIFMPYYGFLNSKLDIPAEPIWWGYAMFNHFAVYETQLPGSDVPLYLMGHPAFDPHRIYSGEDEDWRFTFFANGAAEFSWNYWKPQVIHCHDWHTGMIPVWMHQSPDISTVFTIHNLAYQGPWRWKLEKITWCPWYMQGDSTMAAALLYADRVNTVSPTYAQQIQTPTYGEKLEGLLSFISGKLSGILNGIDVDSYNPATDTRIVANYDRDTLDKRLNNKLALQKEMGLEVNPDRFLIGFVARLVEQKGIDLLLQILDRFLSYSDAQFVVLGTGERYYETQLWELATRYPGRMSTYLMYDEGLSRRIYAGSDAFLVPSRFEPCGITQMLALRYGSVPIVRRTGGLVDTVFHHDPRHAEGNGYCFDRYEPLDLYTCLVRAWESYQYQPQWQKLQQRGMAVDLSWKQSAIAYEQLYAEAIGLPIDVLQEA

SEQ ID NO: 99 - protein, 513 aa, Synechococcus sp. WH8102
MRILFAAAECAPMIKVGGMGDVVGSLPPALAKLGHDVRLIMPGYSKLWTKLTISDEPIWRAQTMGTEFAVYETKHPGNGMTIYLVGHPVFDPERIYGGEDEDWRFTFFASAAAEFAWNVWKPNVLHCHDWHTGMIPVWMHQDPEISTVFTIHNLKYQGPWRWKLDRITWCPWYMQGDHTMAAALLYADRVNAVSPTYAEEIRTAEYGEKLDGLLNFVSGKLRGILNGIDLEAWNPQTDGALPATFSADDLSGKAVCKRVLQERMGLEVRDDAFVLGMVSRLVDQKGVDLLLQVADRLLAYTDTQIVVLGTGDRGLESGLWQLASRHAGRCAVFLTYDDDLSRLIYAGSDAFLMPSRFEPCGISQLYAMRYGSVPVVRKVGGLVDTVPPHSPADASGTGFCFDRFEPVDFYTALVRAWEAYRHRDSWQELQKRGMQQDYSWDRSAIDYDVMYRDVCGLKEPTPDAAMVEQFSQGQAADPSRPEDDAINAAPEAVTAPSGPSRNPLNRLFGRRAD

SEQ ID NO: 100 - protein, 507 aa, Synechococcus sp RCC 307
MRILFAAAECAPMVKVGGMGDVVGSLPPALAELGHDVRVIMPGYGKLWSQLDVPSEPIWRAQTMGTDFAVYETRHPKTGLTIYLVGHPVFDGERIYGGEDEDWRFTFFASATSEFAWNAWKPQVLHCHDWHTGMIPVWMHQDPEISTVFTIHNLKYQGPWRWKLERMTWCPWYMQGDHTMAAALLYADRVNAVSPTYAQEIRTPEYGEQLEGLLNYISGKLRGILNGIDVEAWNPATDSRIPATYSTADLSGKAVCKRALQERMGLQVNPDTFVIGLVSRLVDQKGVDLLLQVAERFLAYTDTQIVVLGTGDRHLESGLWQMASQHSGRFASFLTYDDDLSRLIYAGSDAFLMPSRFEPCGISQLLSMRYGTIPVVRRVGGLVDTVPPYVPATQEGNGFCFDRYEAIDLYTALVRAWEAYRHQDSWQQLMKRVMQVDFSWARSALEYDRMYRDVCGMKEPTPEADAVAAFSIPQPPEQQAARAAAEAADPNPQRRFNPLGLLRRNGG

SEQ ID NO: 101 - protein, 478 aa, Synechococcus sp. PCC 7002
MRILFVSAEAAPIAKAGGMGDVVGSLPKVLRQLGHDARIFLPYYGFLNDKLDIPAEPVWWGSAMFNTFAVYETVLPNTDVPLYLFGHPAFDGRHIYGGQDEFWRFTFFANGAAEFMWNHWKPQIAHCHDWHTGMIPVWMHQSPDISTVFTIHNLAYQGPWRGFLERNTWCPWYMDGDNVMASALMFADQVNTVSPTYAQQIQTKVYGEKLEGLLSWISGKSRGIVNGIDVELYNPSNDQALVKQFSTTNLEDRAANKVIIQEETGLEVNSKAFLMAMVTRLVEQKGIDLLLNILEQFMAYTDAQLIILGTGDRHYETQLWQTAYRFKGRMSVQLLYNDALSRRIYAGSDVFLMPSRFEPCGISQMMAMRYGSVPIVRRTGGLVDTVSFHDPIHQTGTGFSFDRYEPLDMYTCMVRAWESFRYKKDWAELQRRGMSHDFSWYKSAGEYLKMYRQSIKEAPELTTDEAEKITYLVKKHAI

SEQ ID NO: 102 - DNA, 1380 bp, Synechococcus elongatus PCC 7942
atgactgctgtcgttctccctgctgccgctgaaacgctggctgctttacaagcaacctttgatcggggggatacacgcacgctcgccttccgactggcgcgattacaggatctggccaagctagttgctgacaatgaagcggagctattgcaagccttggcgtcagacctccgcaaaccagcactggaagcctacgccagtgagatttatttcgtgcgcgaccaaatcaaactgacctgcaagcatctgcggcgctggatgcaacccgagaagcagtcgatttccttgatgcagcagcctggccaggcctatcgccaagcagaaccgctcggagtcgtgctgatcattggcccctggaactatccctttcagctgctcatcacgccgttgattggggcgatcgcggcgggaaattgtgccgtactcaaaccatcggaactggctcccgcgacttccagcctgattcagcgactgatcagcgatcgctttgaccctgattacatccgcgttttagaaggcgatgctagcgttagccaagccctgattactcagcccttcgatcacatcttcttcactggcggcacggcgatcgggcgaaaagtgatggctgctgcggccgaaaacctgacgcccgtcaccctcgagttgggcggtaagtcaccctgcattgttgataccgatatcgacctcgatgtggccgcccgtcgcatcgcctggggcaaattcttcaacgccggtcaaacctgcattgcgcctgactatttgttggtgcaacgcacggtcgcagagccgttcattgaagcgctgatcgacaacatccagcagttctatggcgaggatccgcaacagagtgctgactacgcccgcattgtcagcgatcgccactggcaaaggctaaatagcctgttggttgatggcacgattcgccatggtggtcaggtggataggagcgatcgctacatcgcaccgactttaattacggacgtcaactggcgcgatcccatcctgcaagaggagatttttgggcccctcttgccgattttgatttacgaccaattggatgaggcgatcgcccaaattcgtgcccagcccaagcccctcgcgctctatctattcagccgcgatcgccaagtgcaagagcgcgtcctagcggaaaccagcgccggtagcgtctgcctcaacgacacgatcctgcaggtcggcgtccccgatgctgcttttggtggggtcggccccagcggcatgggcggctatcacggcaaagccagtttcgaaaccttcagtcactacaagctggtgctcaagcgaccgttttggctcgatctggccctgcgctatccgccctacggcgacaagatcaacctcttccgcaagctctag

SEQ ID NO: 103 - protein, 459 aa, Synechococcus elongatus PCC 7942
MTAVVLPAAAETLAALQATFDRGDTRTLAFRLARLQDLAKLVADNEAELLQALASDLRKPALEAYASEIYFVRDQIKLTCKHLRRWMQPEKQSISLMQQPGQAYRQAEPLGVVLIIGPWNYPFQLLITPLIGAIAAGNCAVLKPSELAPATSSLIQRLISDRFDPDYIRVLEGDASVSQALITQPFDHIFFTGGTAIGRKVMAAAAENLTPVTLELGGKSPCIVDTDIDLDVAARRIAWGKFFNAGQTCIAPDYLLVQRTVAEPFIEALIDNIQQFYGEDPQQSADYARIVSDRHWQRLNSLLVDGTIRHGGQVDRSDRYIAPTLITDVNWRDPILQEEIFGPLLPILIYDQLDEAIAQIRAQPKPLALYLFSRDRQVQERVLAETSAGSVCLNDTILQVGVPDAAFGGVGPSGMGGYHGKASFETFSHYKLVLKRPFWLDLALRYPPYGDKINLFRKL

SEQ ID NO: 104 - DNA, 1011 bp, Synechycystis sp. PCC6083
atgattaaagcctacgctgccctggaagccaacggaaaactccaaccctttgaatacgaccccggtgccctgggtgctaatgaggtggagattgaggtgcagtattgtggggtgtgccacagtgatttgtccatgattaataacgaatggggcatttccaattaccccctagtgccgggtcatgaggtggtgggtactgtggccgccatgggcgaaggggtgaaccatgttgaggtgggggatttagtggggctgggttggcattcgggctactgcatgacctgccatagttgtttatctggctaccacaacctttgtgccacggcggaatcgaccattgtgggccactacggtggctttggcgatcgggttcgggccaagggagtcagcgtggtgaaattacctaaaggcattgacctagccagtgccgggccccttttctgtggaggaattaccgttttcagtcctatggtggaactgagtttaaagcccactgcaaaagtggcagtgatcggcattgggggcttgggccatttagcggtgcaatttctccgggcctggggctgtgaagtgactgcctttacctccagtgccaggaagcaaacggaagtgttggaattgggcgctcaccacatactagattccaccaatccagaggcgatcgccagtgcggaaggcaaatttgactatattatctccactgtgaacctgaagcttgactggaacttatacatcagcaccctggcgccccagggacatttccactttgttggggtggtgttggagcctttggatctaaatctttttccccttttgatgggacaacgctccgtttctgcctccccagtgggtagtcccgccaccattgccaccatgttggactttgctgtgcgccatgacattaaacccgtggtggaacaatttagctttgatcagatcaacgaggcgatcgcccatctagaaagcggcaaagcccattatcgggtagtgctcagccatagtaaaaattag

SEQ ID NO: 105 - protein, 336 aa, Synechycystis sp. PCC6083
MIKAYAALEANGKLQPFEYDPGALGANEVEIEVQYCGVCHSDLSMINNEWGISNYPLVPGHEVVGTVAAMGEGVNHVEVGDLVGLGWHSGYCMTCHSCLSGYHNLCATAESTIVGHYGGFGDRVRAKGVSVVKLPKGIDLASAGPLFCGGITVFSPMVELSLKPTAKVAVIGIGGLGHLAVQFLRAWGCEVTAFTSSARKQTEVLELGAHHILDSTNPEAIASAEGKFDYIISTVNLKLDWNLYISTLAPQGHFHFVGVVLEPLDLNLFPLLMGQRSVSASPVGSPATIATMLDFAVRHDIKPVVEQFSFDQINEAIAHLESGKAHYRVVLSHSKN

SEQ ID NO: 106 - DNA, 1023 bp, Acinetobacter baylyi
atgacaactaatgtgattcatgcttatgctgcaatgcaggcaggtgaagcactcgtgccttattcgtttgatgcaggcgaactgcaaccacatcaggttgaagttaaagtcgaatattgtgggctgtgccattccgatgtctcggtactcaacaacgaatggcattcttcggtttatccagtcgtggcaggtcatgaagtgattggtacgattacccaactgggaagtgaagccaaaggactaaaaattggtcaacgtgttggtattggctggacggcagaaagctgtcaggcctgtgaccaatgcatcagtggtcagcaggtattgtgcacgggcgaaaataccgcaactattattggtcatgctggtggctttgcagataaggttcgtgcaggctggcaatgggtcattcccctgcccgacgaactcgatccgaccagtgctggtcctttgctgtgtggcggaatcacagtatttgatccaattttaaaacatcagattcaggctattcatcatgttgctgtgattggtatcggtggtttgggacatatggccatcaagctacttaaagcatggggctgtgaaattactgcgtttagttcaaatccaaacaaaaccgatgagctcaaagccatgggggccgatcacgtggtcaatagccgtgatgatgccgaaattaaatcgcaacagggtaaatttgatttactgctgagtacagttaatgtgcctttaaactggaatgcgtatctaaacacactggcacccaatggcactttccattttttgggcgtggtgatggaaccaatccctgtacctgtcggtgcgctgctaggaggtgccaaatcgctaacagcatcaccaactggctcgcctgctgccttacgtaagctgctcgaatttgcggcacgtaagaatatcgcacctcaaatcgagatgtatcctatgtcggagctgaatgaggccatcgaacgcttacattcgggtcaagcacgttatcggattgtacttaaagccgatttttaa

SEQ ID NO: 107 - protein, 340 aa, Acinetobacter baylyi
MTTNVIHAYAAMQAGEALVPYSFDAGELQPHQVEVKVEYCGLCHSDVSVLNNEWHSSVYPVVAGHEVIGTITQLGSEAKGLKIGQRVGIGWTAESCQACDQCISGQQVLCTGENTATIIGHAGGFADKVRAGWQWVIPLPDELDPTSAGPLLCGGITVFDPILKHQIQAIHHVAVIGIGGLGHMAIKLLKAWGCEITAFSSNPNKTDELKAMGADHVVNSRDDAEIKSQQGKFDLLLSTVNVPLNWNAYLNTLAPNGTFHFLGVVMEPIPVPVGALLGGAKSLTASPTGSPAALRKLLEFAARKNIAPQIEMYPMSELNEAIERLHSGQARYRIVLKADF

SEQ ID NO: 108 - protein, 415 aa, Cuphea hookeriana
MVAAAASSAFFPVPAPGASPKPGKFGNWPSSLSPSFKPKSIPNGGFQVKANDSAHPKANGSAVSLKSGSLNTQEDTSSSPPPRTFLHQLPDWSRLLTAITTVFVKSKRPDMHDRKSKRPDMLVDSFGLESTVQDGLVFRQSFSIRSYEIGTDRTASIETLMNHLQETSLNHCKSTGILLDGFGRTLEMCKRDLIWVVIKMQIKVNRYPAWGDTVEINTRFSRLGKIGMGRDWLISDCNTGEILVRATSAYAMMNQKTRRLSKLPYEVHQEIVPLFVDSPVIEDSDLKVHKFKVKTGDSIQKGLTPGWNDLDVNQHVSNVKYIGWILESMPTEVLETQELCSLALEYRRECGRDSVLESVTAMDPSKVGVRSQYQHLLRLEDGTAIVNGATEWRPKNAGANGAISTGKTSNGNSVS

SEQ ID NO: 109 - protein, 328 aa, Cuphea hookeriana [sequence omitted]

SEQ ID NO: 110 - protein, 382 aa, Umbellularia californica
MATTSLASAFCSMKAVMLARDGRGMKPRSSDLQLRAGNAPTSLKMINGTKFSYTESLKRLPDWSMLFAVITTIFSAAEKQWTNLEWKPKPKLPQLLDDHFGLHGLVFRRTFAIRSYEVGPDRSTSILAVMNHMQEATLNHAKSVGILGDGFGTTLEMSKRDLMWVVRRTHVAVERYPTWGDTVEVECWIGASGNNGMRRDFLVRDCKTGEILTRCTSLSVLMNTRTRRLSTIPDEVRGEIGPAFIDNVAVKDDEIKKLQKLNDSTADYIQGGLTPRWNDLDVNQHVNNLKYVAWVFETVPDSIFESHHISSFTLEYRRECTRDSVLRSLTTVSGGSSEAGLVCDHLLQLEGGSEVLRARTEWRPKLTDSFRGISVIPAEPRV

SEQ ID NO: 111 - protein, 324 aa, Umbellularia californica
MLPDWSMLFAVITTIFSAAEKQWTNLEWKPKPKLPQLLDDHFGLHGLVFRRTFAIRSYEVGPDRSTSILAVMNHMQEATLNHAKSVGILGDGFGTTLEMSKRDLMWVVRRTHVAVERYPTWGDTVEVECWIGASGNNGMRRDFLVRDCKTGEILTRCTSLSVLMNTRTRRLSTIPDEVRGEIGPAFIDNVAVKDDEIKKLQKLNDSTADYIQGGLTPRWNDLDVNQHVNNLKYVAWVFETVPDSIFESHHISSFTLEYRRECTRDSVLRSLTTVSGGSSEAGLVCDHLLQLEGGSEVLRARTEWRPKLTDSFRGISVIPAEPRV

SEQ ID NO: 112 - protein, 382 aa, Cinnamomum camphora
MATTSLASAFCSMKAVMLARDGRGMKPRSSDLQLRAGNAQTSLKMINGTKFSYTESLKKLPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 113 - protein, 324 aa, Cinnamomum camphora
MLPDWSMLFAVITTIFSAAEKQWTNLEWKPKPNPPQLLDDHFGPHGLVFRRTFAIRSYEVGPDRSTSIVAVMNHLQEAALNHAKSVGILGDGFGTTLEMSKRDLIWVVKRTHVAVERYPAWGDTVEVECWVGASGNNGRRHDFLVRDCKTGEILTRCTSLSVMMNTRTRRLSKIPEEVRGEIGPAFIDNVAVKDEEIKKPQKLNDSTADYIQGGLTPRWNDLDINQHVNNIKYVDWILETVPDSIFESHHISSFTIEYRRECTMDSVLQSLTTVSGGSSEAGLVCEHLLQLEGGSEVLRAKTEWRPKLTDSFRGISVIPAESSV

SEQ ID NO: 114 - protein, 415 aa, Cuphea hookeriana
MVATAASSAFFPLPSADTSSRPGKLGNKPSSLSPLKPKSTPNGGLQVKANASAPPKINGSPVGLKSGGLKTQEDAHSAPPPRTFINQLPDWSMLLAAITTVFLAAEKQWMMLDWKPKRPDMLVDPFGLGSIVQDGLVFRQNFSIRSYEIGADRTASIETVMNHLQETALNHVKIAGLSNDGFGRTPEMYKRDLIWVVAKMQVMVNRYPTWGDTVEVNTWVAKSGKNGMRRDWLISDCNTGEILTRASSVWVMMNQKTRRLSKIPDEVRNEIEPHFVDSPPVIEDDDRKLPKLDEKTADSIRKGLTPRWNDLDVNQHVNNVKYIGWILESTPPEVLETQELCSLTLEYRRECGRESVLESLTAMDPSGGGYGSQFQHLLRLEDGGEIVKGRTEWRPKNGVINGVVPTGESSPGDYS

SEQ ID NO: 115 - protein, 329 aa, Cuphea hookeriana
MLPDWSMLLAAITTVFLAAEKQWMMLDWKPKRPDMLVDPFGLGSIVQDGLVFRQNFSIRSYEIGADRTASIETVMNHLQETALNHVKIAGLSNDGFGRTPEMYKRDLIWVVAKMQVMVNRYPTWGDTVEVNTWVAKSGKNGMRRDWLISDCNTGEILTRASSVWVMMNQKTRRLSKIPDEVRNEIEPHFVDSPPVIEDDDRKLPKLDEKTADSIRKGLTPRWNDLDVNQHVNNVKYIGWILESTPPEVLETQELCSLTLEYRRECGRESVLESLTAMDPSGGGYGSQFQHLLRLEDGGEIVKGRTEWRPKNGVINGVVPTGESSPGDYS

SEQ ID NO: 116 - protein, 9 aa, Artificial Sequence
  Domain 1 lipid phosphatase catalytic motif
  VARIANT (2)..(2): Xaa = Any Amino Acid
  VARIANT (3)..(3): Xaa = Any Amino Acid
  VARIANT (4)..(4): Xaa = Any Amino Acid
  VARIANT (5)..(5): Xaa = Any Amino Acid
  VARIANT (6)..(6): Xaa = Any Amino Acid
  VARIANT (7)..(7): Xaa = Any Amino Acid
KXXXXXXRP

SEQ ID NO: 117 - protein, 4 aa, Artificial Sequence
  Domain 2 lipid phosphatase catalytic motif
PSGH

SEQ ID NO: 118 - protein, 12 aa, Artificial Sequence
  Domain 3 lipid phosphatase catalytic motif
  VARIANT (3)..(3): Xaa = Any Amino Acid
  VARIANT (4)..(4): Xaa = Any Amino Acid
  VARIANT (5)..(5): Xaa = Any Amino Acid
  VARIANT (6)..(6): Xaa = Any Amino Acid
  VARIANT (7)..(7): Xaa = Any Amino Acid
  VARIANT (9)..(9): Xaa = Any Amino Acid
  VARIANT (10)..(10): Xaa = Any Amino Acid
  VARIANT (11)..(11): Xaa = Any Amino Acid
SRXXXXXHXXXD

SEQ ID NO: 119 - DNA, 1250 bp, Rhodococcus sp.
atgacccgaggcttcgttctccggcaggccgtcggcgccgcactcgccgccaacgccctgcgtcccctgcccggtgcgcccacgtcggtggtcgcgttcttctcagggtggctcaccaccgaactcgcaccgcacctgctcgccgtgaccgccgccgacgccgcccagcacgccgcgcgtcacggaacgcgaacccgaagcgaccgtgtcggcctcgcgctggccgccgcatccgccgccgggctcgccgccgtgatcgccaccggtcgtggcgccggagcggaagccgaatccgcgctcgtcgagacgctcggcgagaactacaccgaccgcgacagcgccatcgaacacccggggcggcccgtgtggcggcaactcctcaacccgttctggatgcggaacaaagcggtcacccgggtccgcaacctcgcgtacgggccgggcgggcgccgggcccgcctcgacatctaccaccggcaggatctgccgtcgaagagcccggtcctcctgcagatccacggcggcggatgggtgatcgggaacaaggatcaacagggtctgccgctcatgctcgagatggcctcgcgggggtgggtgtgcgcggccgtcaactacccgctgtcgccgaaggcgaagtggcccgaacacctgatcgcaatcaagcaggcgctggcctggctccgggagcacgtcgaggagtacggcggcaaccccgacttcatcgccgtcacaggtggttccgcgggtggccacctcgccgccatggtgggactcaccgcgaacgacagtcacctgcagccggggttcgaggacgtcgacacgtccgttcaggcgtgtgtcccgtactacggtgtctacgacatcgccggcgacaccggaatcaaggcggtcctccagcgcgtgcactccggactgatgccgatggtgctcggcaagcacgccacgttccccgacgactaccgggccgcgtccccgctcgcgcacctgcgggcggacgcaccgccgttcttcgtgattcacggcacgagcgattcgctgatccccgtcgccgaggcgcggatcttcgtcgacgagctccggcaggtgtccgacaaccccgtcgtctacgccgaattgaagggcgcgcagcacgcgttcgacgtgttcccctcgatccgcagcatctccgtcacgcaggcggtcgggcgcttcctggaatggtcgcgcagcgccaccaccgacgtgcccgcggcgggcacggaatcggcctg

SEQ ID NO: 120 - protein, 416 aa, Rhodococcus sp.
MTRGFVLRQAVGAALAANALRPLPGAPTSVVAFFSGWLTTELAPHLLAVTAADAAQHAARHGTRTRSDRVGLALAAASAAGLAAVIATGRGAGAEAESALVETLGENYTDRDSAIEHPGRPVWRQLLNPFWMRNKAVTRVRNLAYGPGGRRARLDIYHRQDLPSKSPVLLQIHGGGWVIGNKDQQGLPLMLEMASRGWVCAAVNYPLSPKAKWPEHLIAIKQALAWLREHVEEYGGNPDFIAVTGGSAGGHLAAMVGLTANDSHLQPGFEDVDTSVQACVPYYGVYDIAGDTGIKAVLQRVHSGLMPMVLGKHATFPDDYRAASPLAHLRADAPPFFVIHGTSDSLIPVAEARIFVDELRQVSDNPVVYAELKGAQHAFDVFPSIRSISVTQAVGRFLEWSRSATTDVPAAGTESA

SEQ ID NO: 121 - protein, 183 aa, Escherichia coli
MADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 122 - DNA, 987 bp, Artificial Sequence
  Codon optimized polynucleotide encoding mature form of C8/C10FatB
atgctgccagattggagccgactcttgaccgccatcaccacagtctttgttaagtctaaacggcccgacatgcacgatcgaaaaagcaagcgccccgatatgctggtggacagctttggcttggaatctaccgtgcaggatgggttggtctttcgacagagtttctcgattcgcagttatgaaattggcactgatcgtacggcaagcattgagactctgatgaaccacttgcaagagacaagcttgaaccattgcaaatcgacagggattctcctcgatggcttcggtcgtacgctggaaatgtgcaagcgcgatctgatttgggttgtgatcaaaatgcagattaaggttaaccgttatcccgcatggggtgatacggtggaaattaacacgcggttctcccgcctgggaaaaatcggcatgggacgcgattggctgatctccgattgcaacacgggcgagatcctcgtgcgcgctacttcggcctacgccatgatgaatcaaaaaacccggcgcctcagtaagctgccctacgaggtgcaccaagaaattgttccgttgtttgtggatagccctgtcatcgaggattcggatctgaaggtccataaattcaaagttaaaacgggagactcgatccaaaagggcttgacgccgggttggaatgacctggacgtcaatcagcatgtttcgaacgtgaaatacatcggctggattctggagtccatgccaaccgaagtgttggaaacccaggagttgtgttcgctcgctctcgaataccggcgcgaatgtggccgtgatagtgttctcgagagtgtcaccgccatggaccctagcaaagtcggggtgcgctctcagtatcaacacctgttgcgcttggaagacggcacagcgatcgtgaatggtgcgaccgagtggcgtccgaagaacgccggtgcgaatggtgcaatttcgactgggaagaccagcaatggtaatagtgtcagttag

SEQ ID NO: 123 - DNA, 1561 bp, Umbellularia californica
agagagagagagagagagagagctaaattaaaaaaaaaacccagaagtgggaaatcttccccatgaaataacggatcctcttgctactgctactactactactacaaactgtagccatttatataattctatataattttcaacatggccaccacctctttagcttccgctttctgctcgatgaaagctgtaatgttggctcgtgatggccggggcatgaaacccaggagcagtgatttgcagctgagggcgggaaatgcgccaacctctttgaagatgatcaatgggaccaagttcagttacacggagagcttgaaaaggttgcctgactggagcatgctctttgcagtgatcacaaccatcttttcggctgctgagaagcagtggaccaatctagagtggaagccgaagccgaagctaccccagttgcttgatgaccattttggactgcatgggttagttttcaggcgcacctttgccatcagatcttatgaggtgggacctgaccgctccacatctatactggctgttatgaatcacatgcaggaggctacacttaatcatgcgaagagtgtgggaattctaggagatggattcgggacgacgctagagatgagtaagagagatctgatgtgggttgtgagacgcacgcatgttgctgtggaacggtaccctacttggggtgatactgtagaagtagagtgctggattggtgcatctggaaataatggcatgcgacgtgatttccttgtccgggactgcaaaacaggcgaaattcttacaagatgtaccagcctttcggtgctgatgaatacaaggacaaggaggttgtccacaatccctgacgaagttagaggggagatagggcctgcattcattgataatgtggctgtcaaggacgatgaaattaagaaactacagaagctcaatgacagcactgcagattacatccaaggaggtttgactcctcgatggaatgatttggatgtcaatcagcatgtgaacaacctcaaatacgttgcctgggtttttgagaccgtcccagactccatctttgagagtcatcatatttccagcttcactcttgaatacaggagagagtgcacgagggatagcgtgctgcggtccctgaccactgtctctggtggctcgtcggaggctgggttagtgtgcgatcacttgctccagcttgaaggtgggtctgaggtattgagggcaagaacagagtggaggcctaagcttaccgatagtttcagagggattagtgtgatacccgcagaaccgagggtgtaactaatgaaagaagcatctgttgaagtttctcccatgctgttcgtgaggatactttttagaagctgcagtttgcattgcttgtgcagaatcatggtctgtggttttagatgtatataaaaaatagtcctgtagtcatgaaacttaatatcagaaaaataactcaatgggtcaaggttatcgaagtagtcatttaagctttgaaatatgttttgtattcctcggcttaatctgtaagctctttctcttgcaataaagttcgcctttcaat

SEQ ID NO: 124 - DNA, 975 bp, Artificial Sequence
  Codon optimized polynucleotide encoding mature form of C12FatB1 from Umbellularia californica
atgctgccggattggagtatgttgttcgcggtcattaccaccatcttctcggccgcggaaaagcagtggactaatctcgaatggaagcccaagcctaaattgccgcaactgttggatgatcactttggtctgcatggcctggtcttccgacgaactttcgccatccgctcttacgaggtcggtccagatcgatcgacgtccattctggcggtgatgaaccacatgcaggaagctacactgaatcacgccaagagtgtcggcatcctgggcgatggttttggtacgacgctcgagatgagtaagcgcgatttgatgtgggtggtccgccgcacacatgtggccgtcgaacgctatcctacgtggggtgacacggtcgaagtcgagtgttggatcggagccagcggcaataatgggatgcggcgcgattttctcgtgcgggattgtaagaccggtgaaattctgacacgttgcaccagcctctccgtcctgatgaacacgcggactcgccgcctgtcgactatcccggatgaagtgcgcggcgaaattgggcccgcatttatcgacaatgttgctgtcaaggatgacgagattaaaaaactgcaaaaactcaacgatagcactgccgattacattcaaggcggactcacgccgcgttggaacgacctcgacgttaaccagcacgtgaacaacctcaaatacgtggcatgggtcttcgaaaccgttccagacagcatcttcgaatctcatcatatcagctcgttcacgttggagtatcgtcgtgagtgcacccgggattccgtgttgcgatctctgaccaccgtttccgggggcagcagcgaggctggactcgtttgcgaccacctgctgcaattggaaggcggctcggaggtgctgcgagcacggaccgaatggcgcccgaaattgacggatagctttcggggcattagtgttatccccgccgagccccgcgtttag

SEQ ID NO: 125 - DNA, 975 bp, Artificial Sequence
  Codon optimized polynucleotide encoding mature form of C14FatB1 from Cinnamomum camphora
atgttgcccgattggagcatgttgttcgcagtcatcaccaccattttcagcgcagcggagaagcaatggaccaatttggagtggaaaccaaagccgaatccccctcagctgctggatgatcattttggaccccacgggttggtctttcgccgaacgtttgccatccgcagctatgaagtgggcccggatcgctcgacgagcattgttgctgttatgaatcacctgcaagaagcggctctgaatcatgctaagagcgtgggtatcttgggcgacggtttcgggacaactctggagatgtcgaagcgcgatctgatctgggtggtcaaacgtacccatgtggctgttgaacggtacccggcctggggagatactgtggaggttgagtgctgggttggcgcaagcggcaataacggccgccgacatgatttcctcgtgcgcgactgtaaaaccggcgaaattttgacccgatgcacctcgctcagtgtcatgatgaacacgcgcactcgtcggctgtccaaaatccccgaggaagtccgtggcgagatcggaccggcgttcattgacaacgtggcagtgaaggacgaagaaattaaaaagccgcagaagctgaacgattccacagcggattacatccagggtggtctgacgccccggtggaacgacctcgacattaaccagcacgtcaataacattaagtacgtggattggatcttggaaacagtgccggattcgatttttgagtcgcatcatatcagcagttttacgatcgaatatcgccgcgaatgtacgatggatagcgtgttgcagagcctcacgacagtctctggggggagtagtgaggccggtctggtctgcgaacacctgctccaactcgaaggcggttctgaagtgctccgtgccaaaactgagtggcgccctaaactcactgactcgtttcggggtatttccgtcattccagccgagtccagtgtttag

SEQ ID NO: 126 - DNA, 1430 bp, Cinnamomum camphora
tcaacatggccaccacctctttagcttctgctttctgctcgatgaaagctgtaatgttggctcgtgatggcaggggcatgaaacccaggagcagtgatttgcagctgagggcgggaaatgcacaaacctctttgaagatgatcaatgggaccaagttcagttacacagagagcttgaaaaagttgcctgactggagcatgctctttgcagtgatcacgaccatcttttcggctgctgagaagcagtggaccaatctagagtggaagccgaagccgaatccaccccagttgcttgatgaccattttgggccgcatgggttagttttcaggcgcacctttgccatcagatcgtatgaggtgggacctgaccgctccacatctatagtggctgttatgaatcacttgcaggaggctgcacttaatcatgcgaagagtgtgggaattctaggagatggattcggtacgacgctagagatgagtaagagagatctgatatgggttgtgaaacgcacgcatgttgctgtggaacggtaccctgcttggggtgatactgttgaagtagagtgctgggttggtgcatcgggaaataatggcaggcgccatgatttccttgtccgggactgcaaaacaggcgaaattcttacaagatgtaccagtctttcggtgatgatgaatacaaggacaaggaggttgtccaaaatccctgaagaagttagaggggagatagggcctgcattcattgataatgtggctgtcaaggacgaggaaattaagaaaccacagaagctcaatgacagcactgcagattacatccaaggaggattgactcctcgatggaatgatttggatatcaatcagcacgttaacaacatcaaatacgttgactggattcttgagactgtcccagactcaatctttgagagtcatcatatttccagcttcactattgaatacaggagagagtgcacgatggatagcgtgctgcagtccctgaccactgtctccggtggctcgtcggaagctgggttagtgtgcgagcacttgctccagcttgaaggtgggtctgaggtattgagggcaaaaacagagtggaggcctaagcttaccgatagtttcagagggattagtgtgatacccgcagaatcgagtgtctaactaacgaaagaagcatctgatgaagtttctcctgtgctgttgttcgtgaggatgctttttagaagctgcagtttgcattgcttgtgcagaatcatggcctgtggttttagatatatatccaaaattgtcctatagtcaagaaacttaatatcagaaaaataactcaatgagtcaaggttatcgaagtagtcatgtaagctttgaaatatgttgtgtattcctcggctttatgtaatctgtaagctctttctcttgcaataaatttcgcctttcaat

SEQ ID NO: 127 - DNA, 1744 bp, Cuphea hookeriana
ctttgatcggtcgatcctttcctctcgctcataatttacccattagtcccctttgccttctttaaaccctcctttcctttctcttcccttcttcctctctgggaagtttaaagcttttgcctttctcccccccacaacctctttcccgcatttgttgagctgtttttttgtcgccattcgtcctctcctcttcagttcaacagaaatggtggctaccgctgcaagttctgcattcttccccctcccatccgccgacacctcatcgagacccggaaagctcggcaataagccatcgagcttgagccccctcaagcccaaatcgacccccaatggcggtttgcaggttaaggcaaatgccagtgcccctcctaagatcaatggttccccggtcggtctaaagtcgggcggtctcaagactcaggaagacgctcattcggcccctcctccgcgaacttttatcaaccagttgcctgattggagtatgcttcttgctgcaatcacgactgtcttcttggctgcagagaagcaatggatgatgcttgattggaaacctaagaggcctgacatgcttgtggacccgtttggattgggaagtattgttcaggatgggcttgtgttcaggcagaatttttcgattaggtcctatgaaataggcgccgatcgcactgcgtctatagagacggtgatgaaccatttgcaggaaacagctctcaatcatgttaagattgctgggctttctaatgacggctttggtcgtactcctgagatgtataaaagggaccttatttgggttgttgcgaaaatgcaagtcatggttaaccgctatcctacttggggtgacacggttgaagtgaatacttgggttgccaagtcagggaaaaatggtatgcgtcgtgactggctcataagtgattgcaatactggagagattcttacaagagcatcaagcgtgtgggtcatgatgaatcaaaagacaagaagattgtcaaaaattccagatgaggttcgaaatgagatagagcctcattttgtggactctcctcccgtcattgaagacgatgaccggaaacttcccaagctggatgagaagactgctgactccatccgcaagggtctaactccgaggtggaatgacttggatgtcaatcaacacgtcaacaacgtgaagtacatcgggtggattcttgagagtactccaccagaagttctggagacccaggagttatgttcccttactctggaatacaggcgggaatgtggaagggagagcgtgctggagtccctcactgctatggatccctctggagggggttatgggtcccagtttcagcaccttctgcggcttgaggatggaggtgagatcgtgaaggggagaactgagtggcggcccaagaatggtgtaatcaatggggtggtaccaaccggggagtcctcacctggagactactcttagaagggagccctgacccctttggagttgtgatttctttattgtcggacgagctaagtgaagggcaggtaagatagtagcaatcggtagattgtgtagtttgtttgctgctttttcacgatggctctcgtgtataatatcatggtctgtcttctttgtatcctcttcttcgcatgttccgggttgattcatacattatattctttctatttgtttgaaggcgagtagcgggttgtaattatttattttgtcattacaatgtcgtttaacttttcaaatgaaactacttatgtg

SEQ ID NO: 128 - DNA, 990 bp, Artificial Sequence
  Codon optimized polynucleotide encoding mature form of C16FatB1 from Cuphea hookeriana
atgctgcctgactggtcgatgctgttggctgcaattactaccgtcttcctggcggctgaaaaacaatggatgatgttggactggaagcccaaacgacccgatatgctcgtcgatccgttcgggttgggcagcatcgttcaagacggtctggtgtttcgccaaaatttttccattcgatcttatgaaatcggcgctgaccggacagcatccatcgaaacggtcatgaaccatctccaagagaccgccctgaatcacgtgaagattgccggactctccaatgatggattcggccggaccccggaaatgtacaaacgcgatctgatctgggtggtcgccaagatgcaggtcatggtcaatcggtacccgacctggggggacacggttgaggtcaacacttgggtggcgaaatcgggtaagaacggcatgcgccgcgactggctcattagcgactgcaatacgggcgagatcctcacgcgtgccagttctgtgtgggtcatgatgaaccagaaaactcgacgcttgagcaagattccagatgaagttcgtaatgagattgaacctcattttgttgactcgccccccgtgatcgaggatgatgatcggaagctccccaagctggacgaaaaaacggcggatagcatccgcaaaggcctgacaccacggtggaacgatctggatgtcaatcaacacgtgaacaacgtgaaatacatcgggtggattctcgaatctacccccccagaagttctcgagactcaggagctgtgcagcttgacgttggagtaccgccgagaatgtggccgtgagtcggtgctggagagtctgaccgcaatggacccgtcgggcggtggttatggcagtcagtttcagcatttgctgcgcttggaggatggtggggaaattgtgaaaggtcggactgaatggcgccccaagaatggagtgattaatggtgttgtccctacaggcgaaagtagccccggggattatagttag

SEQ ID NO: 129 - DNA, 2595 bp, Artificial Sequence
  Codon-optimized S. cerevisiae phosphatidate phosphatase (PAH1)
atggaattccaatatgttggtcgggctttgggtagtgttagtaaaacgtggtcgagtatcaaccccgccaccctgagcggcgctatcgatgtcattgtcgtggaacaccccgatggccggctcagttgtagccccttccatgtgcgctttggtaaattccagattctgaaacccagccaaaagaaagtccaggtctttattaacgagaaactgtcgaatatgcccatgaaactctcggatagcggcgaggcgtacttcgtttttgagatgggtgatcaagtgacggatgtcccggatgaactgctcgtctcgccggtcatgagtgccacgagtagtccgccccaatcgccggaaacctcgattctcgaaggcggtaccgaaggcgagggcgaaggtgagaatgaaaataagaaaaaggaaaagaaggtgttggaggagcccgactttctggacattaatgacaccggtgacagcggcagcaagaacagtgagacgacgggttcgctctcgccgaccgaaagtagtacgacgacgccgcccgatagcgtcgaggaacgcaagttggtcgaacaacggaccaagaattttcagcaaaagctgaataagaaactgaccgaaatccatattccgagcaaattggacaataacggtgatttgctcctggacaccgagggttataagccgaataaaaacatgatgcacgacacggatattcagctgaagcaattgctcaaggatgagttcggtaacgatagcgatatttcgagcttcatcaaagaagacaagaatggcaacattaaaatcgtgaacccctatgagcatttgaccgatttgagtcccccgggtacgcccccgaccatggccacgagtggcagtgtcctgggcttggatgcgatggagagtggttcgacgctgaacagcttgagcagcagcccgagcggcagtgacaccgaggatgagacgagctttagcaaggaacagtcgtcgaagagtgaaaaaacgtcgaagaaaggcaccgcgggttcgggtgaaacggagaaacgctacatccgcacgatccggctcacgaatgatcagctgaaatgcctcaacttgacgtacggtgaaaatgacttgaaatttagtgttgaccatggcaaagccattgtgaccagcaaattgtttgtctggcgctgggacgtccccatcgttatcagcgacattgacggtacgattacgaaaagtgatgcgctgggccacgtcctcgccatgatcggcaaagattggacccatctcggcgtcgctaagctgttcagtgagatctcgcgcaacggttacaatatcctgtacctgaccgcgcgctcggccggtcaggctgacagtacccgctcgtatctccgcagtattgagcagaacggtagcaagctcccgaacggccccgtcattctgagccccgatcggaccatggctgccctgcgccgggaggtgattctgaaaaagcccgaagtctttaaaatcgcttgcttgaacgatatccgctcgctctatttcgaagactcggataacgaagtggacacggaggaaaagagcacgccgtttttcgcgggctttggcaatcggatcaccgatgcgctcagctatcggacggtcggcatcccgagtagccgcatcttcacgattaacacggaaggcgaggtgcacatggagctgctcgagctcgccggttaccggagtagctatatccatatcaacgaactggtcgatcacttcttcccgccggtgagcctggactcggtcgatctgcgcacgaacacgagcatggtcccgggcagcccgccgaaccgcaccctggataactttgatagcgaaatcaccagtggccgcaagacgttgtttcgcggtaatcaggaggaaaaattcacggacgtcaacttttggcgcgatccgttggtggacatcgacaacctctcggatatcagtaacgatgattcggacaatattgatgaagacaccgatgtgagccaacagtcgaacatcagccgcaaccgcgctaactcggtcaagacggccaaggtgaccaaggctccgcagcggaatgtgtcgggcagtacgaataacaatgaagttctggctgcgagtagtgatgttgaaaatgccagtgacttggttagcagccactcgagtagcggctcgacccccaacaagtcgacgatgagtaagggtgatatcggcaaacaaatctatctggaactgggctcgcccttggcgagtcccaaactccggtatctggacgatatggatgatgaggactcgaactataatcgcaccaagagccgccgggctagtagcgccgctgctaccagcatcgacaaggagtttaaaaagctcagtgtgagtaaagctggcgctcccacccgcatcgttagcaagatcaacgtgtcgaatgatgtgcacagtttgggcaacagtgataccgaaagccggcgggaacagagcgtcaatgaaaccggtcgcaatcagttgccgcacaatagtatggatgataaggatttggattcgcgggtgagtgacgagttcgatgacgatgagtttgatgaagatgagtttgaggattag

SEQ ID NO: 130 - DNA, 2589 bp, Artificial Sequence
  Synthetic construct Saccharomyces cerevisiae clone FLH148377.01X SMP2 gene
atgcagtacgtaggcagagctcttgggtctgtgtctaaaacatggtcttctatcaatccggctacgctatcaggtgctatagatgtcattgtagtggagcatccagacggaaggctatcatgttctccctttcatgtgaggttcggcaaatttcaaattctaaagccatctcaaaagaaagtccaagtgtttataaatgagaaactgagtaatatgccaatgaaactgagtgattctggagaagcctatttcgttttcgagatgggtgaccaggtcactgatgtccctgacgaattgcttgtgtcgcccgtgatgagcgccacatcaagcccccctcaatcacctgaaacatccatcttagaaggaggaaccgagggtgaaggtgaaggtgaaaatgaaaataagaagaaggaaaagaaagtgctagaggaaccagattttttagatatcaatgacactggagattcaggcagtaaaaatagtgaaactacagggtcgctttctcctactgaatcctctacaacgacaccaccagattcagttgaagagaggaagcttgttgagcagcgtacaaagaactttcagcaaaaactaaacaaaaaactcactgaaatccatatacccagtaaacttgataacaatggcgacttactactagacactgaaggttacaagccaaacaagaatatgatgcatgacacagacatacaactgaagcagttgttaaaggacgaattcggtaatgattcagatatttccagttttatcaaggaggacaaaaatggcaacatcaagatcgtaaatccttacgagcaccttactgatttatctcctccaggtacgcctccaacaatggccacaagcggatcagttttaggcttagatgcaatggaatcaggaagtactttgaattcgttatcttcttcaccttctggttccgatactgaggacgaaacatcatttagcaaagaacaaagcagtaaaagtgaaaaaactagcaagaaaggaacagcagggagcggtgagaccgagaaaagatacatacgaacgataagattgactaatgaccagttaaagtgcctaaatttaacttatggtgaaaatgatctgaaattttccgtagatcacggaaaagctattgttacgtcaaaattattcgtttggaggtgggatgttccaattgttatcagtgatattgatggcaccatcacaaaatcggacgctttaggccatgttctggcaatgataggaaaagactggacgcacttgggtgtagccaagttatttagcgagatctccaggaatggctataatatactctatctaactgcaagaagtgctggacaagctgattccacgaggagttatttgcgatcaattgaacagaatggcagcaaactaccaaatgggcctgtgattttatcacccgatagaacgatggctgcgttaaggcgggaagtaatactaaaaaaacctgaagtctttaaaatcgcgtgtctaaacgacataagatccttgtattttgaagacagtgataacgaagtggatacagaggaaaaatcaacaccattttttgccggctttggtaataggattactgatgctttatcttacagaactgtggggatacctagttcaagaattttcacaataaatacagagggtgaggttcatatggaattattggagttagcaggttacagaagctcctatattcatatcaatgagcttgtcgatcatttctttccaccagtcagccttgatagtgtcgatctaagaactaatacttccatggttcctggctccccccctaatagaacgttggataactttgactcagaaattacttcaggtcgcaaaacgctatttagaggcaatcaggaagagaaattcacagacgtaaatttttggagagacccgttagtcgacatcgacaacttatcggatattagcaatgatgattctgataacatcgatgaagatactgacgtatcacaacaaagcaacattagtagaaatagggcaaattcagtcaaaaccgccaaggtcactaaagccccgcaaagaaatgtgagcggcagcacaaataacaacgaagttttagccgcttcgtctgatgtagaaaatgcgtctgacctggtgagttcccatagtagctcaggatccacgcccaataaatctacaatgtccaaaggggacattggaaaacaaatatatttggagctaggttctccacttgcatcgccaaaactaagatatttagacgatatggatgatgaagactccaattacaatagaactaaatcaaggagagcatcttctgcagccgcgactagtatcgataaagagttcaaaaagctctctgtgtcaaaggccggcgctccaacaagaattgtttcaaagatcaacgtttcaaatgacgtacattcacttgggaattcagataccgaatcacgaagggagcaaagtgttaatgaaacagggcgcaatcagctaccccacaactcaatggacgataaagatttggattcaagagtaagcgatgaattcgatgacgatgaattcgacgaagatgaattcgaagattag

SEQ ID NO: 131 - protein, 864 aa, Saccharomyces cerevisiae
MEFQYVGRALGSVSKTWSSINPATLSGAIDVIVVEHPDGRLSCSPFHVRFGKFQILKPSQKKVQVFINEKLSNMPMKLSDSGEAYFVFEMGDQVTDVPDELLVSPVMSATSSPPQSPETSILEGGTEGEGEGENENKKKEKKVLEEPDFLDINDTGDSGSKNSETTGSLSPTESSTTTPPDSVEERKLVEQRTKNFQQKLNKKLTEIHIPSKLDNNGDLLLDTEGYKPNKNMMHDTDIQLKQLLKDEFGNDSDISSFIKEDKNGNIKIVNPYEHLTDLSPPGTPPTMATSGSVLGLDAMESGSTLNSLSSSPSGSDTEDETSFSKEQSSKSEKTSKKGTAGSGETEKRYIRTIRLTNDQLKCLNLTYGENDLKFSVDHGKAIVTSKLFVWRWDVPIVISDIDGTITKSDALGHVLAMIGKDWTHLGVAKLFSEISRNGYNILYLTARSAGQADSTRSYLRSIEQNGSKLPNGPVILSPDRTMAALRREVILKKPEVFKIACLNDIRSLYFEDSDNEVDTEEKSTPFFAGFGNRITDALSYRTVGIPSSRIFTINTEGEVHMELLELAGYRSSYIHINELVDHFFPPVSLDSVDLRTNTSMVPGSPPNRTLDNFDSEITSGRKTLFRGNQEEKFTDVNFWRDPLVDIDNLSDISNDDSDNIDEDTDVSQQSNISRNRANSVKTAKVTKAPQRNVSGSTNNNEVLAASSDVENASDLVSSHSSSGSTPNKSTMSKGDIGKQIYLELGSPLASPKLRYLDDMDDEDSNYNRTKSRRASSAAATSIDKEFKKLSVSKAGAPTRIVSKINVSNDVHSLGNSDTESRREQSVNETGRNQLPHNSMDDKDLDSRVSDEFDDDEFDEDEFED

SEQ ID NO: 132 - DNA, 861 bp, Escherichia coli
atgagtcaggcgctaaaaaatttactgacattgttaaatctggaaaaaattgaggaaggactctttcgcggccagagtgaagatttaggtttacgccaggtgtttggcggccaggtcgtgggtcaggccttgtatgctgcaaaagagaccgtccctgaagagcggctggtacattcgtttcacagctactttcttcgccctggcgatagtaagaagccgattatttatgatgtcgaaacgctgcgtgacggtaacagcttcagcgcccgccgggttgctgctattcaaaacggcaaaccgattttttatatgactgcctctttccaggcaccagaagcgggtttcgaacatcaaaaaacaatgccgtccgcgccagcgcctgatggcctcccttcggaaacgcaaatcgcccaatcgctggcgcacctgctgccgccagtgctgaaagataaattcatctgcgatcgtccgctggaagtccgtccggtggagtttcataacccactgaaaggtcacgtcgcagaaccacatcgtcaggtgtggatccgcgcaaatggtagcgtgccggatgacctgcgcgttcatcagtatctgctcggttacgcttctgatcttaacttcctgccggtagctctacagccgcacggcatcggttttctcgaaccggggattcagattgccaccattgaccattccatgtggttccatcgcccgtttaatttgaatgaatggctgctgtatagcgtggagagcacctcggcgtccagcgcacgtggctttgtgcgcggtgagttttatacccaagacggcgtactggttgcctcgaccgttcaggaaggggtgatgcgtaatcacaattaa

SEQ ID NO: 133 - protein, 208 aa, Escherichia coli
MMNFNNVFRWHLPFLFLVLLTFRAAAADTLLILGDSLSAGYRMSASAAWPALLNDKWQSKTSVVNASISGDTSQQGLARLPALLKQHQPRWVLVELGGNDGLRGFQPQQTEQTLRQILQDVKAANAEPLLMQIRLPANYGRRYNEAFSAIYPKLAKEFDVPLLPFFMEEVYLKPQWMQDDGIHPNRDAQPFIADWMAKQLQPLVNHDS

SEQ ID NO: 134 - protein, 286 aa, Escherichia coli
MSQALKNLLTLLNLEKIEEGLFRGQSEDLGLRQVFGGQVVGQALYAAKETVPEERLVHSFHSYFLRPGDSKKPIIYDVETLRDGNSFSARRVAAIQNGKPIFYMTASFQAPEAGFEHQKTMPSAPAPDGLPSETQIAQSLAHLLPPVLKDKFICDRPLEVRPVEFHNPLKGHVAEPHRQVWIRANGSVPDDLRVHQYLLGYASDLNFLPVALQPHGIGFLEPGIQIATIDHSMWFHRPFNLNEWLLYSVESTSASSARGFVRGEFYTQDGVLVASTVQEGVMRNHN

SEQ ID NO: 135 - DNA, 1023 bp, Escherichia coli
atgtttcagcagcaaaaagactgggaaacaagagaaaacgcgtttgctgcttttaccatgggaccgctgactgatttctggcgtcagcgtgatgaagcagagtttactggtgtggatgacattccggtgcgctttgtccgttttcgcgcacagcaccatgaccgggtggtagtcatctgcccggggcgtattgagagctacgtaaaatatgcggaactggcctatgacctgttccatttggggtttgatgtcttaatcatcgaccatcgcgggcagggacgttccggtcgcctgttagccgatccgcatctcgggcatgttaatcgctttaatgattatgttgatgatctggcggcattctggcagcaggaggttcagcccggtccgtggcgtaaacgctatatactggcacattcgatgggcggtgcgatctccacattatttctgcaacgccatccaggtgtatgtgacgccattgcgctaactgcgccaatgtttgggatcgtgattcgtatgccgtcatttatggcacggcagatcctcaactgggccgaagcgcatccacgtttccgtgatggctatgcaataggcaccgggcgctggcgcgcgttgccgtttgctatcaacgtactgacccacagcagacagcgatatcgacgtaacttacgcttctatgctgatgacccaacgattcgcgtcggtgggccgacctaccattgggtacgcgaaagtattctggctggcgaacaggtgttagccggtgcgggtgatgacgccacgccaacgcttctcttgcaggctgaagaggaacgcgtggtggataaccgcatgcatgaccgtttttgtgaactccgcaccgccgcgggccatcctgtcgaaggaggacggccgttggtaattaaaggtgcttaccatgagatcctttttgaaaaggacgcaatggcctcagtcgcgctccacgccatcgttgattttttcaacaggcataactcacccagcggaaaccgctctacagaggtttaa

SEQ ID NO: 136 - DNA, 1203 bp, Artificial Sequence
  Vupat1 - nucleotide sequence codon optimized for S. elongatus 7942.
atggccgccacacagacccctagtaaagttgacgatggtgcactgattacggtgctctcgattgacggggggggtatccgcgggatcatccctgggattctcctcgcgttcctcgagagcgaattgcaaaaactggatggtgctgatgcccgtctcgccgactactttgatgtcatcgcaggcacttctaccggaggcttggttactgctatgctgaccgcgccaaatgagaataatcgccccctctacgctgctaaagatattaaagatttctatctcgaacacaccccaaaaatctttccgcagtcgtcgagctggaacctgattgccaccgcgatgaagaagggccgcagcctgatggggccacagtacgacggcaaatacctgcataaattggtccgtgaaaaactgggcaatacgaagctcgagcacactctgaccaacgtggtcatcccggcgttcgacatcaaaaatctgcaacccgccattttcagtagcttccaagttaagaaacgcccctacctcaatgcagccctcagcgacatttgtatctcgaccagcgctgcacccacgtatctgccagcgcactgctttgaaacaaagacttcgacggccagtttcaagtttgacttggtggatgggggcgtcgctgcgaataaccctgcgttggtcgccatggccgaggtctcgaacgaaatccgcaacgagggttcgtgcgcttccctgaaggtgaaaccgctgcagtacaaaaagtttctggtcatttctctgggaaccggctcccagcaacacgaaatgcgatattccgcagataaggccagcacgtggggcttggtcggatggctcagctcgtccggtggcaccccgctgattgacgtcttctctcatgcgagctccgatatggttgattttcatattagtagtgtgtttcaagcccgccacgcagaacaaaactacctgcggattcaagacgataccctgacgggtgatctgggctccgtcgatgttgccacagagaagaatttgaacggtctcgtgcaggtggccgaagcgttgctgaagaagcccgttagcaaaatcaatttgcgtacgggtatccacgaaccggttgaatctaacgaaacgaatgctgaagcgttgaagcggtttgcagcacggttgtctaaccagcggcgatttcgcaaaagtcagactttcgcttag

SEQ ID NO: 137 - protein, 340 aa, Escherichia coli
MFQQQKDWETRENAFAAFTMGPLTDFWRQRDEAEFTGVDDIPVRFVRFRAQHHDRVVVICPGRIESYVKYAELAYDLFHLGFDVLIIDHRGQGRSGRLLADPHLGHVNRFNDYVDDLAAFWQQEVQPGPWRKRYILAHSMGGAISTLFLQRHPGVCDAIALTAPMFGIVIRMPSFMARQILNWAEAHPRFRDGYAIGTGRWRALPFAINVLTHSRQRYRRNLRFYADDPTIRVGGPTYHWVRESILAGEQVLAGAGDDATPTLLLQAEEERVVDNRMHDRFCELRTAAGHPVEGGRPLVIKGAYHEILFEKDAMASVALHAIVDFFNRHNSPSGNRSTEV

SEQ ID NO: 138 - protein, 400 aa, Synechococcus elongatus PCC 7942
MAATQTPSKVDDGALITVLSIDGGGIRGIIPGILLAFLESELQKLDGADARLADYFDVIAGTSTGGLVTAMLTAPNENNRPLYAAKDIKDFYLEHTPKIFPQSSSWNLIATAMKKGRSLMGPQYDGKYLHKLVREKLGNTKLEHTLTNVVIPAFDIKNLQPAIFSSFQVKKRPYLNAALSDICISTSAAPTYLPAHCFETKTSTASFKFDLVDGGVAANNPALVAMAEVSNEIRNEGSCASLKVKPLQYKKFLVISLGTGSQQHEMRYSADKASTWGLVGWLSSSGGTPLIDVFSHASSDMVDFHISSVFQARHAEQNYLRIQDDTLTGDLGSVDVATEKNLNGLVQVAEALLKKPVSKINLRTGIHEPVESNETNAEALKRFAARLSNQRRFRKSQTFA

SEQ ID NO: 139 - DNA, 552 bp, Escherichia coli
atggctgatacattgctgattttgggtgatagtttgtctgcgggttaccgcatgagcgccagcgccgcctggccagccctcctgaatgataaatggcagtccaaaacgagcgttgtcaatgcgtctattagtggcgataccagtcaacagggactggctcgcctcccggccttgctgaaacagcatcaaccgcgctgggtgctggtcgaactcggagggaatgatggtctgcgcggttttcaacctcagcaaaccgagcaaacgctccgtcaaattctgcaggacgttaaggcggcgaacgctgagcccctgctgatgcagattcgcctccccgccaattacgggcgtcgctataacgaagcgttttcggcgatttacccgaagctcgccaaagaatttgatgtcccactgctcccctttttcatggaagaagtctatctcaaaccacaatggatgcaggatgatggcattcatcccaaccgcgacgcgcaaccctttattgcggattggatggcgaaacaactccaaccactcgtgaaccacgattcgtag

SEQ ID NO: 140 - DNA, 1161 bp, Acinetobacter sp ADP1
atggcgtttagatttattgaggggattcccacaagtttgggcgtgttcggtgtggtaggttcattgtgtatgtcgcatgcacatgcaattgaagctgtacagacttctgcaacaattacgcccaccagtcctgcggcttgcattggtttggagtcgaattcagatcgtctggcttgttatgatgctctgtttaaagtagcagatacggcaaaaacaactccagttattgaacaaaaagctgctttgaacccttcgccgtcggtagagcagtctgagctcaatcctcaatctattaaggaaaaaattggtaatctttttgcgattgaaggtccaagaattgatccgaatacatccttactggataggcgctgggagctctccgaaaaatcaaaattaggtacatggaatattcgtggttataaacctgtctatttattacctattttttggacatctaaaaagaatgaatttccttcgagtccaaatcctgaaaatacagtgcatgaaaatcagaatttaacttcggctgaatccaagtttcaattatctttaaaaaccaaagcctgggaaaatatttttggcaataacggagatttatggctagggtatacccagtcttctcgttggcaggtttacaatgcagacgagtcacgtccgtttcgtgaaaccaattatgaacctgaggcaagcctaattttccgaaccaattatgagttcttgggattaaacggccgacttttgggggtaactttaaatcaccagtcaaatggtcgttctgatccattatcaagaagctggaatcgtgtcatctttaatataggattagagcgagataattttgcgctggtactcagaccatggattcgtattcaagaagaagccaagaacgacaataatcccgatatcgaggattatgtaggacgtggtgatttaactgctttttatcgctggaaagataatgatttttctttaatgctgcgtcattcattaaaagatggtgataaatcgcatggtgcggtgcagtttgattgggctttcccaatttcaggtaagcttcgtggaaattttcagttatttaatggttacggtgaaagcctgattgattataaccatcgtgcaacttatgttggtttgggcgtttcactgatgaactggtattga

SEQ ID NO: 141 - DNA, 870 bp, Escherichia coli
atgcggactctgcagggctggttgttgccggtgtttatgttgcctatggcagtatatgcacaagaggcaacggtgaaagaggtgcatgacgcgccagcggtgcgtggcagtattatcgccaatatgctgcaggagcatgacaatccgttcacgctctatccttatgacaccaactacctcatttacacccaaaccagcgatctgaataaagaagcgattgccagttacgactgggcggaaaatgcgcgtaaggatgaagtaaagtttcagttgagcctggcatttccgctgtggcgtgggattttaggcccgaactcggtgttgggtgcgtcttatacgcaaaaatcctggtggcaactgtccaatagcgaagagtcttcaccgtttcgtgaaaccaactacgaaccgcaattgttcctcggttttgccaccgattaccgttttgcaggttggacgctgcgcgatgtggagatggggtataaccacgactctaacgggcgttccgacccgacctcccgcagctggaaccgcctttatactcgcctgatggcagaaaacggtaactggctggtagaagtgaagccgtggtatgtggtgggtaatactgacgataacccggatatcaccaaatatatgggttactaccagcttaaaatcggctatcacctcggtgatgcggtgctcagtgcgaaaggacagtacaactggaacaccggctacggcggcgcggagttaggcttaagttacccgatcaccaaacatgtgcgcctttatactcaggtttacagcggctatggcgaatcgctcatcgactataacttcaaccagacccgtgtcggtgtgggggttatgctaaacgatttgttttga

SEQ ID NO: 142 - DNA, 1188 bp, Streptomyces coelicolor A3(2)
atgaccgtcgttgaaccgactcccggtgccgaccgggtcagcatccaacggctgcgtcgccgtttggaaaggctgatcggtgtcgccgccaccgaagggaacgaactcgtcgcgctgcgcaacggcgacgagatcttccccgccatgctgggggcgatccgggcggccgagcacacgatcgacatgatgacgttcgtgtactggcgcgggcagatagcccgcgacttcgccgccgctctcgccgaccgggcccggtcgggagtacgggtccggctgctgctggacggcttcggcgccaaggagatcgaacaggacctgctggacgctatggaggccgcgggagtacagatcgcctggttccgtaaaccgctgtggctgtcgccgttcaagcagaaccaccgctgccaccgcaaggccctcgtcattgacgagcacactgccttcaccggaggcgtcggcatcgccgaggagtggtgcggcgacgcccgcggccccggcgagtggcgcgacacccacgtccaggtgcgcggcccggccgtggacggcgtcgccgccgccttcgcccagaactgggccgagtgccacgacgagttgtacgacgaccgggaccggttctccgatcacacccagcccggcacatccatcgtccaggtggtgcgcggttcggccagcttcggttggcaggacatgcagaccctcatccgcgtcatgctcacctccgcggagcaccgcttccgcctggcgaccgcctacttcgccccggatacatacttcatcgacctgctctgcgccaccgcccggcgcggtgtcacggtggagatcctgctccccggcccgcatacggaccagcgggcctgccaactggccggccagtaccactacacccgtttgctggacgccggggtgtcaattcgcgagtaccagccgaccatgatgcacgccaagatcatcaccgtggacgggctggccgccctgatcgggtccaccaacttcaaccggcgctccatggaccacgacgaggagatcatgctcgccgtcctggaccaggagttcaccaacggcctggaccgggacttcgacgccgacctggaacgcagcaccgccatcgagccgacccgctggaagcgccgcgccaccctgcgacgcctccgggagacggccgtcctgcccctgcgccggttcctgtga

SEQ ID NO: 143 - DNA, 658 bp, Arabidopsis thaliana
attcgtcttctaccttcttctaactcacttcattttcaccaaaaccaacaaatatattcttctcactttccgagctttccagttcaactatggcggctccgatcatacttttctctttccttttattcttctctgtctctgtctcggcacttaacgtcggtgttcagctcatacatccctccatttccttgactaaagaatgtagccggaaatgtgaatcagagttttgttcagtgcctccatttctgaggtatgggaagtactgtggactactttacagtggatgtcctggtgagagaccttgtgatggtcttgattcttgttgcatgaaacatgatgcttgtgtccaatccaagaataatgattatctaagccaagagtgtagtcagaagttcattaactgcatgaacaatttcagccagaagaagcaaccgacgttcaaaggtaacaaatgcgacgctgatgaagtgattgatgtcatctccattgtcatggaagctgctcttatcgccggcaaagtcctcaagaaaccctaactatttatatatatttttctatatttctagttacaattgtttccctttttttccccctcaggacatttgtcttaatttatcaaaatactattaagtaatactatagcttttttttttttgtc

SEQ ID NO: 144 - DNA, 1074 bp, Arabidopsis thaliana
atggagtatcaggggcttcaaaattgggacggtcttttagacccattggacgacaatctccggcgagagattctccggtacggtcaatttgtcgaatcggcttatcaagcatttgatttcgatccttcctctccaacctacgggacatgccggtttccgaggagcacgttgttagagcgatccggtttacccaactccggttatcgactaacgaagaaccttcgtgccacgtcaggtattaacttgccacgttggattgagaaagcgccaagctggatggctacacaatctagctggattggttacgtggcagtttgccaggacaaagaagagatctcgcggcttgggcgtagagacgtcgtcatctccttccgtggaaccgccacgtgtctcgagtggttagagaaccttcgcgccacgctgactcatctccctaatgggcctactggagcaaatctaaacgggtctaactctgggcccatggttgagagcgggtttttaagcttgtatacttcaggtgttcacagtttgagagacatggtaagagaagagatcgcaaggctactccaatcttacggcgacgagccgttaagtgtaacgataaccggtcacagcctcggcgctgcgatcgcgacactagcagcttacgatatcaaaacgacgtttaaacgtgcgcctatggttaccgtaatatctttcggaggtccacgtgtcggaaacagatgctttcggaaactccttgagaagcaaggcacgaaggttctaagaatcgtgaactccgacgacgtcatcaccaaagttcctggagttgttttagaaaacagagagcaagataacgttaagatgacagcgtcgataatgccgagctggatacagagacgcgtggaggagacgccgtgggtttacgctgaaatcggtaaggagcttcggctgagtagccgtgactcgccgcacttgagcagcatcaatgtggccacgtgtcatgagctgaaaacgtatttacatttggtagacgggtttgtgagctccacgtgtccattcagagaaacagctcggagagttctccatagatga

SEQ ID NO: 145 - DNA, 1416 bp, Arabidopsis thaliana
atggcggccaaagtcttcactcagaaccctatctattctcaatctctagttagagacaaaactcctcaacagaaacacaatcttgaccatttctctatatcccagcacacctctaaaagactcgttgtctcttcttctacaatgtcccctccgatttcatcttctccactctctcttccttcttcttcttcttctcaggccattcctccttctcgagcacctgcagtgactctaccgttgtctcgggtttggagagagatacaagggagcaataactgggaaaatctcattgaacctctaagccctattctccaacaagagatcactcgctacgggaacttactctccgcttcttacaaagggtttgatctaaaccctaactccaaacgttacttgagttgcaagtatggaaaaaagaacttgcttaaagaatccggaatccatgaccctgatggctaccaagtcaccaagtatatctacgccacaccagacatcaacctcaaccctatcaagaacgagcctaaccgtgcacgttggatcggttatgtagcggtttcttctgatgaatcggtgaaacgtttgggaaggagggatattttggtgacgtttcgtggcactgtcaccaaccatgagtggttagctaacctaaagagctctttgactccggctaggcttgatcctcataaccctcgtcctgatgtcaaggtcgaatccgggttcttaggtttatacacatccggtgagagcgagagcaaattcgggctagaaagctgccgtgagcagcttctctccgagatctcgaggcttatgaacaagcacaaaggcgaggaaataagcataacacttgcgggacatagtatggggagttctctagctcagcttctagcttacgacatagcggaactcggtatgaaccagagaagggacgaaaaacctgttccggtgaccgtgttttcgtttgctggtcctagagttggtaacttggggttcaaaaaacggtgtgaggagctaggagttaaagtcttgaggatcacgaatgtaaacgatccgatcaccaaacttccaggtttcttatttaatgagaatttcagatctttaggtggtgtttacgagcttccttggagctgttcttgctacactcacgtgggagtcgaactcaccctcgatttcttcgatgttcaaaacatttcttgtgtccatgacctcgagacttacatcactctagtaaaccgtccgagatgctcgaaattggcggttaatgaagacaattttggcggcgagtttttgaacagaacaagtgaactgatgttcagtaagggacgacgtcaagcgttgcattttacaaacgcagcgaccaatgcggcatatctactttgttctatatccaaccatatgttgtattataatatattttag

SEQ ID NO: 146 - DNA, 1285 bp, Arabidopsis thaliana
aatcgccctccaagaaaaacaaaccgccatcgtgcggatcactcgtaaccatcctcagccttgatggtggtggagtcagaggaatcatcgccggagtaatccttgcctttctcgaaaaacaacttcaggaactcgatggagaagaggcgaggcttgcggattacttcgacgtgatagctggaactagcaccggtggtcttgtgacggcgatgttgactgtaccggacgagaccggtcgacctcatttcgcggctaaagacattgtgccgttttaccttgaacattgtcccaagatatttccccagcccacaggcgtgcttgctctgttaccgaagcttccaaagcttctgtctggtccaaagtacagcggaaagtatctgcgaaatcttctgagtaagcttcttggagagacaagacttcaccagaccctcacaaacattgttatacctaccttcgatatcaagaaacttcaacccactattttctcctcttaccagctgttggttgaccctagcttggatgtcaaggtatcagacatatgcatcggcacttcagctgctcccactttctttcctccccattacttttccaacgaagacagtcaaggcaataagacggagtttaatctcgttgatggcgcggttactgctaataacccgactttggtggccatgacagctgtgtctaagcagattgtgaagaataatcctgatatgggtaagctcaagccgttaggtttcgaccggtttctcgttatatcgataggaacaggatcaacaaaaagggaagagaagtacagcgcaaaaaaggctgcaaaatgggggatcatatcttggttatatgacgatggatctactccgatattagacattaccatggaatcaagccgcgacatgatccattatcacagctctgttgtgtttaaagccctacaatctgaagacaagtacctccgaatcgatgatgatacattggaaggagatgtaagcactatggatctagcgacaaagtctaacttggagaatcttcaaaagattggagagaagatgctgacaaacagagtcatgcaaatgaacatcgacactggtgtatatgaacctgttgctgaaaatattaccaatgatgaacagctaaagaggtatgcaaaaattctctcggacgaaaggaaattaaggagactaagaagcgacacaatgattaaagattcatcaaatgaatcacaagagataaaataaaaggaaatcattcgtgcttttgtgtgaaattgtttgttgcatatgtttta

SEQ ID NO: 147 - DNA, 2061 bp, Anabaena variabilis ATCC 29413
gtgataaatctagcaaatacacaaacagtcttaaaatttgatgggatagatgattatatagattttggcaaaaacgatattggtggtgtttttgctcaagggagttcatgttttacggtttcaggatggataaatcctcataaattaacagaaaaatccactagctatggaacgcggaatgtattttttgctcgttcttcagatcgatacagtgataattttgaattcggtatcagtgagacagggagtttagatatcttcattgatgaaaccattagcaagggtatcagaacttttggtaatggagaattaactataggacaatggcactttttcgccattgtttttaatagcggtcaaatcacagtatatcttgatgatcatgaatacaatgactctctgagaggttcatctttaaacaaagcaacaagctctgtaactttgggtgcaaccttacacaagcaagtctattttacaggacaattagcaaacatcagcgtctggaattatccatgtactcaggtacaaattaagacccatcattgtgggctaatagtcggggatgaaccaggattagtggcttactggaaattagatgaaggccaaggaacaacagttaaaaacaaagctggaaaatcttatcaaggaaattttcggggtaatcctagctgggatttagcgcaaattccatttgcagcaccattatccagtcaagacgatatccaggaggatgtccaatttgagataggaattattgccgaaacaagtatttcaacattaactacagatttattggcagcaacagtaccgctagttagtaacaacgaagaccaaacaatagaaattcaatatccagaaataaatagcgaaaaatcagagattattgcaaacttgatcaatctcccatcacatgaagaagcaagcaaaacagaccaaactgaagttcttgtaaatagccaacaattacaaacattcattcaggcagaatcgccagaaaccatgaatacaaaatcccgtcccagatataaaatactttccattgatggtggtggtattcggggcattattcctgcattactcttagcagaaattgaacgacggacacaagagcctatatttagtttatttgacttaattgctggtacttcaagcggcggaattttagcactgggactaactaaaccccgattaaattcatctgaagaattgcccttagctgaatacaccgctgaagaccttgtacaattatttcttgagtatggagtagaaatattttatgagccattatttgaaagactacttggcccgttagaagatatatttctccagccaaaatatccttccacaagcaaagaagaaatcttaaggcaatatttgggtaaaactcctctagtaaataatcttaaagaagtttttgtcactagttacgatatcgagcagcgaattccggtattttttacaaaccaactagaaaaacagcaaatagaatctaagaattctcataatttatgtggtaatgtatccctcttagatgccgcattagccactagtgctaccccgacttattttgctcctcatcgtatcgtcagccccgaaaatagtgcgatcgcttatactttaattgacgggggagtatttgctaataacccagcccatttagctattttagaagcgcaaattagtagtaaacgcaaagcccaaacagtccttaatcaagaagatattttagtagtttctttaggtacaggttcgccaacaagtgcttatccttataaagaagtcaagaattggggacttttacaatggggaagaccacttttaaatattgtgtttgacggtggtagcggtgtggtatctggagaattagaacagttgtttgaacctagcgataaagaagctaaaagtttttattatcgctttcaaacattgttagatgcagagttagaagcaatagataatacgaaactacaaaatactcgtcagctacaagctatagcccacaaactgatttctgaaaaaagtcaacaaatcgatgaactttgtgagcttttgttgggctaa

SEQ ID NO: 148 - DNA, 1995 bp, Saccharomyces cerevisiae S288c
atgaagttgcagagtttgttggtttctgctgcagttttgacttctctaacagagaacgttaacgcttggtcaccaaataacagttacgtccctgcgaacgtaacctgtgatgatgatattaacttagtcagagaagcatctggtttgtcagataacgaaacagaatggctgaaaaaaagagatgcatacaccaaggaggctttgcattcttttttgaatagggccacttcgaatttcagtgacacttccttgctatccactctttttggtagcaactcttccaatatgcctaagattgccgtcgcctgttctggtggtggttaccgtgccatgttgtctggtgctggtatgcttgctgctatggacaatcgtactgatggcgcaaatgagcatggtcttggtgggctgctgcaaggtgcaacttacttggcaggtctgtcgggtggtaactggttaacaagtactttggcttggaacaactggacgtctgtgcaagctatcgtggataatacaacagaatctaactcaatttgggacatctctcattcaattcttaccccagacggcattaacatctttaagactgggagtagatgggacgacatatcagatgacgttcaggataaaaaagacgccggtttcaacatctctttggcggatgtttggggccgtgctcttgcgtacaatttttggccaagcttacaccgtggtggtgtagggtacacatggtcaactttaagggaagctgatgtcttcaagaatggagaaatgcccttccctatcactgttgcagacggtagatacccaggtaccaccgtgataaacttgaatgccactcttttcgaatttaatccctttgaaatgggttcatgggaccccactttgaacgcatttacggatgtgaagtatttaggtaccaacgttacaaacggtaaaccagttaataaaggccaatgcattgccgggtttgataacactggtttcataacagccacttcatctacgttgtttaaccaatttttactaagattgaattctaccgatttaccttcatttattgctaacttagccaccgatttcctggaagatttatccgacaatagtgacgatattgcaatttacgccccaaatccattcaaggaagctaattttcttcaaaagaacgcaacctccagtattatcgaatcagaatatctatttttggttgatggtggtgaagataaccaaaatattcctttagttccattgttgcaaaaggaacgtgaactagatgttatttttgcattagacaattctgctgatactgacgactattggccagatggtgcttcattagttaacacttatcagcgtcaatttggcagccaaggtctcaatttgtctttcccatatgttccagatgtgaacacatttgtcaacttggggttgaacaaaaagccaaccttttttggttgtgatgcaagaaatttgacagacttggagtacattccaccattaattgtttacattccaaattcaagacattcatttaatggtaaccaaagtacttttaagatgtcatactccgattcagaacgtcttggtatgattaagaatgggtttgaagctgccacaatgggtaattttactgatgattctgatttcttgggctgtgttggttgcgccattatcagacgtaagcaacaaaacttgaatgctacattgccctctgaatgcagccagtgttttaccaactactgctggaacggtactattgacagcaggtcagtctcaggtgtaggaaatgatgattattcttcttctgcttccttgtctgcctccgccgctgctgcctctgcctctgcctctgcctctgcttccgcctctgcctctgcttctgggtcttccactcataagaaaaatgcgggcaatgctttggtgaattattctaacttaaacactaacacttttattggtgtcttaagtgtcattagtgccgtcttcggtctaatttag

SEQ ID NO: 149 - DNA, 2121 bp, Saccharomyces cerevisiae S288c
atgcaattacggaacatattacaggctagctcgctaatttctggactttcgctcgctgcagattcgtcgtccactactggtgatggttatgctccatcaataattccttgtcccagtgatgatacctctttagttagaaacgcgtctggcttatctaccgctgaaactgattggttaaagaaaagagatgcgtacactaaagaagctttacattccttcttaagcagagctacttctaacttcagtgacacttctttgctatccactcttttcagtagtaactcttccaatgtacccaaaattggtattgcatgctctggtggtggttatcgtgccatgttgggtggtgctggtatgattgctgctatggacaatcgtactgatggtgctaacgagcatggtcttggtggtttactacaaagttccacgtatctatcgggtttgtccggtggtaactggttgactggtactttggcatggaacaattggacctctgtacaggaaattgtagaccatatgagtgagagcgattccatctggaatatcacgaaatccattgtgaaccctggtggctctaatttgacctacacaattgaaagatgggagtccattgtacaagaagtgcaggctaagtctgatgcaggcttcaatatatctttgtcggatttgtgggcccgtgcactttcttacaacttctttccaagcttgccagatgctggctccgctttgacttggtcctctttgagagatgttgatgtgttcaaaaacggtgaaatgcctttaccaattactgttgcagatggtagatacccaggtaccaccgtgataaacttgaatgccactcttttcgagttcactccatttgaaatgggttcttgggatccttctttgaacgcttttacggatgtgaaatatctaggtaccaacgttacaaatggtaaaccggtcaacaaggatcaatgcgtttctggttacgataatgctggatttgtaattgccacatccgccagtttattcaacgaattttccctggaagcttccacttcgacctattataaaatgattaatagttttgccaacaagtacgttaacaacctatcccaagatgacgatgatattgcaatttacgctgcaaatccattcaaggatacagaatttgttgaccgcaattacacttccagtattgttgatgccgatgatttgtttttagttgatggtggtgaggacggccaaaatttgccgttggttccactaatcaagaaggaacgtgacttggatgtggtgttcgcattggatatatccgacaatactgatgaatcatggccaagtggtgtgtgcatgacgaacacttatgagcgccagtattctaagcaaggtaaaggaatggctttcccatatgttccagacgttaacaccttccttaacttgggcttaactaataagccaacgttttttggttgtgatgcaaaaaatttgacggacttggagtatattccacctttagttgtatatatcccaaacacaaaacattcattcaatggtaaccaaagtactttgaagatgaactacaatgttacagaacgtcttggaatgatcagaaatggttttgaagctgctacaatgggcaactttacggatgactctaactttttaggttgcataggttgtgccatcattagacgtaagcaagaaagcctaaatgccaccttgccccctgaatgtaccaaatgttttgcggattactgctggaacggcacactaagtacctcagctaatcctgaactatcgggaaatagtacgtatcaaagcggtgctattgcctctgcaatctctgaggctactgacggtattccaataacggctctcttaggttcatcaacctccggaaatactacatcaaactcaacaacctcgacttcatcaaatgtcacttctaactcaaactcttcgtcaaatacaactttaaactcaaattcttcatcctcttcaatttcttcctctacagctcgttcttcttcctctacggcaaacaaagcgaatgctgcggctatttcctatgcgaacactaatactctaatgagtttgttaggtgccataacagcattatttggactaatttag

SEQ ID NO: 150 - DNA, 636 bp, Acinetobacter sp. ADP1
atgcaactgtataacatgtttttagacgggaaatgggcaaaatggttcttgattggttcatttagcgtaataccttttacagtttcggcaaaaaccattcttatcttaggcgacagtctgagtgcgggttatggcattaaccccgaacagggctgggtcgctttattacaaaaacgtctggatcaacaatttcccaagcagcataaagtcattaatgccagtgtaagtggggaaaccaccagtggtgctttagctcgtttacccaaactacttactacttatcgacctaatgtggtggtcattgagcttggtggtaatgatgcattaagaggacaaccgcctcaaatgattcaaagtaatctggaaaaattaatccagcacagccaaaaggcaaaatctaaagtcgtggtgtttggaatgaaaataccaccaaattatggcactgcctatagtcaggcatttgaaaataattataaggtagtgagtcaaacatatcaggttaagttgttgccattttttcttgatggtgtggctggacacaaaagtctaatgcaaaatgaccagatccatccaaatgccaaagcccagtcaatcttgctaaataacgcatacccatatattaaaggcgctttataa

SEQ ID NO: 151 - DNA, 1029 bp, Acinetobacter sp. ADP1
atgtcagatatcccgtttctgaatccgacaatactacaacagcttgatttacctgtacctagtcgtgatcaaacccctttagtgttgcctcagttaaatctcaatcattcttttgagccttcacgtgatttattggcctatcgaaagttatatggtttagatctactggctggtgattactggcaaggctatattcagatgcccttgtttcgtttacatgtacaagtttttacgccagaaagagaaattccattaggaacggtgtgcttattacatggctatcttgaacatagtggtatttatcaaccgatcatccgtgaaatactggatcaaggttttagtgtggtcacttatgatctgcctggacatggattaagtgatggatcacccgctaatattcagaattttgatcattatcaacaggttttaatggcggtttaccagtatgttaaaaatgcagatcagttgcctaaaccttggttaggaattggtcaaagtacaggtggcgcaatctggatgcatcatttgttggaatatgcagagaaacgacaagatccgattgttgatcgggtattactattgtcaccactcatacgcccagcaaaaacggcatggtggcataattctgtgggtttaggcattattcgaagaattcgtcgtcaagttccaagacattttagacgtaataatcataatcctgagtttttacgttttatccgtcttaaagatccgttacaaccacgcatgatgggaatggactggatacttgcgatgtcaaaatggatgtttgaaatggaacagcgaccagcctgtcgtataccagtatggcttgcacaaggggcattagatcagactgtagattggcgttataacattgaatttattcgacgtaaatttcgcttacaaaccttgttgatgttagaagaaggatctcatcaactcatcaatgagcgcgctgatattcgtgctgctttgacaggacttattccagcatttttacatgctcgtccaaaacatcattattattaa

SEQ ID NO: 152 - DNA, 840 bp, Rhodococcus jostii RHA1
atgcagcatcgagaatcatccttcgccggcgtcggcggaattcccatcgtctacgacgtgtggctccccgagcggcgcccgcgcggcgtgctggttctgtgccacggcttcggcgagcatgcccggcggtacgaccatgtgatcgaacggctcggggaactcgacctcgcgatctacgcgcccgaccaccgtgggcacgggcggtcgggcggcaaacgggtccatctgaaggactggaccgagttcaccgacgacctgcaccagttgttcggcatcgcgtcgacggactggcccggcaccgaccggtttctcctcgggcacagcatgggcggttccatcgcgctgacctacgcactcgaccaccagcaggacctgaaggcactcatgctgtccgggcctgcggtcgacgtgacgagcggcacgccgcgcatcgtggtggagatcggcaagctggtgggtcgcttccttcccggagtgcccgtcgagtcgctcgacgcgaagttggtctcccgcgatcctgcggtcgtgtcggcctacgaggaggatcccctcgtccaccacgggaaggtgcctgccgggattgcgcgcgggatgatcctcgccgccgaacggttgccggaacgtctgccgtcgctgacgattcccctgcttctccagcacggccaggacgacggactcgcgagtgtgcacggcacggaactgatcgcggagtacgtcggttcggaggatctcacggtggagatctacgaaaacctgttccacgaggtgttcaacgaaccggagaacgaggaggtactcgacgacctcgtcgagtggttgcggccgcgcgtgcaggcctga

SEQ ID NO: 153 - DNA, 2546 bp, Artificial Sequence
  Codon optimized SDP1
catatggacatcagtaatgaggcaagcgttgacccctttagtattgggccgtcttcgatcatgggccgaaccatcgcttttcgagttctcttctgtcgcagcatgagtcaactgcgccgggatttgttccgctttttgctccactggtttctgcgctttaaactgacggtgagtccattcgtctcctggttccacccgcgcaatccacaaggcattctcgcggttgtcaccatcattgcctttgtcttgaaacgctatacgaatgtgaagatcaaagccgagatggcgtaccgtcggaagttttggcggaacatgatgcggacagcattgacttacgaagagtgggcccatgcagctaaaatgctggagaaggagacgccgaagatgaatgagagcgatctctatgacgaagaattggttaaaaacaaactgcaagagctgcggcatcgccgtcaagaaggatcgctgcgcgatatcatgttttgcatgcgagcggacctggtccgcaatctgggcaacatgtgtaacagtgagctgcataaagggcgactccaagtgccccgccacatcaaagaatatatcgatgaagttagtacccagctgcgcatggtttgcaattcggatagcgaggagctgagcttggaagagaaactctcgttcatgcacgaaacacgtcatgcgtttggtcgcactgctttgttgctgtccgggggtgcgtccctgggtgcattccatgtcggagtggtccgaacgctggtggagcacaagctgctgccccgaatcattgcgggctccagcgttggtagcatcatctgcgcagttgtcgcttcccggagttggccggagctgcagtcgttttttgaaaacagcctccatagtttgcagtttttcgatcagctcggaggagtgttctccatcgtgaagcgcgttatgacgcagggtgccctccatgacattcggcaattgcaatgtatgttgcgaaacctcacctcgaacctcactttccaggaggcttatgacatgacaggtcgaatcttgggaattaccgtgtgttcgcctcgcaagcacgaaccgccacgttgtctcaattacctgacctcgccccatgtcgtcatctggagtgccgtcacggcgagttgtgcgtttcctggcttgttcgaggcacaggagttgatggcgaaagaccgcagcggcgaaattgttccgtaccatcctccgtttaatctcgatccagaggtggggacgaaaagctcgagcggccggcgctggcgcgatgggagcctcgaagtcgatctgcccatgatgcagttgaaggaactctttaacgtcaatcacttcatcgtgagccaggccaatcctcatattgcacccctgctccgactcaaggatctggtgcgcgcatacggtggccgttttgccgcaaaattggctcatttggtcgagatggaagtgaaacaccggtgcaaccaggtgttggaactcggcttccccctgggcggcctcgccaaactgtttgcccaagaatgggaaggtgatgtcacggttgtcatgccggcgaccctggctcagtatagcaagatcattcaaaatccgacccatgtggaactccaaaaggccgccaatcaagggcgtcgttgcacttgggagaagctgtctgcgatcaagagtaactgcggtattgaactggccctggatgatagcgtggcgattctcaatcacatgcgccgcctgaagaagtccgccgaacgagccgccactgcgacctcgtccagccaccacggcttggcctccaccacgcgctttaatgcttcgcggcgcatccccagttggaatgtcctggcccgtgagaactctacgggttctctcgatgacctggtcactgacaacaatctccacgcgtccagtggtcgcaacctgtcggattctgaaacagagtcggtcgaactgtcgtcctggactcggacggggggcccactgatgcgcactgctagtgctaataagttcattgatttcgtgcagtctctcgatattgacatcgcattggtgcgtggtttttcgtcgagcccgaactcgcctgccgtgcctcctggcgggagcttcacacccagtccccggagcattgctgcgcattctgacattgagtctaactcgaacagcaataatctgggaacctccacatccagtattactgtgacagagggtgatctcctgcaacccgaacgtacctctaatggcttcgttctcaacgttgtgaaacgggaaaacttgggcatgcctagcattggcaaccaaaacaccgaactgccggaaagcgttcaactggacattcctgaaaaagagatggattgcagcagcgtgagcgagcatgaagaagacgacaatgataacgaggaagaacataacggaagttcgttggtcaccgtttcttcggaggacagtggtctgcaggaacccgtgtctgggtccgtgattgatgcttaggaagagcaaatcgataagctcttcgttactatccatacgatgttcccgattacgcttagagatct

SEQ ID NO: 154 - DNA, 1506 bp, Acinetobacter sp. ADP1
atgttaggcataaaaaagtcagatatgaatccttatcaagctcatcgcataaaaaaattaaaataccagcttgaaaatgccgaaagctatgaagagtggaaatctaccgcattgcaactcgatgaagaaacgggtttgcaagaatggaaatatgataactgttctgcctattttgatgctgagctgatctcataccgactcaatttattacgtaaatatcgcctgcaacagcgcgtcatggattctgtatatctgttacaggagggattaacgcatgatattgccaacattggacatccaatgctttttgcagccacttatgttggaaccaagcaaattatcgaggactatattgaggaagtatctttatcactcgcatttattgcggcaagtcaatgtcagaccttaacggtggcagagaaactcaaattctttaaaaattgtcaaaagacctatggacagccagcactcatgttttcaggtggtgctactttgggtttgtttcatagtggagtatgtaaaactctgatccagcaagatttgatgccgagagtgttatcaggctcaagtgctggtgcgattatggctggtatgcttggtacttcaactgcatcagaatttcagaaaattttattaggcgaaaacttttttagtgaggcttttcattttcgtggtgtcagagacctgcttaaaggaaatggcggttttgcggatgtgaaatatctgaaaaagtttttgattgaaaatctgggcgacttaaccttttcagaagcgtatgaaagatctggattgcatattaatgttgctgttgctccttatgatggctcgcaaaatgcaagaatcttaaatgcgtacactgcacctaatcttttggtctggagtgctgtgttggcttcatgtgcagtgcctgttttatttccgcctgtacgtctgaccagtaaaaaacgtgacggtagccatacgccttatatggccaatactaaatgggtagatggcagcgttagaagtgattttccacaggaaaaaatggcgcgtttatataatttgaattatacgattgccagtcaagtcaatccgcatgtggttccttttatgcagagcgatgcatcacgctatcgaaaggatattctgagttggccgcaacgtattttacgtcgtcaaggtaaagtgatttcattaggcatcatggattttacccgtgaacgattaggcaatgttccgccagtcagacgcttgcttgatcatggttatggcatagtggggcagaggtattatggtgacgtcaatatcattgcgccgttcaatctgcggcagtatgcatatatgctgcaaaaccctcgaccacacttatttaagttacttcaacagcagggagagcgtgccacatggccaaaaatttctgccattgaaacacatgctcggattggtaaaacgattcagcactgtatcgaggtactggattatcaaaaaaatcgatatatacaagctgaaaaagccagtgcttaa

SEQ ID NO: 155 - DNA, 1413 bp, Rhodococcus jostii RHA1
atgatcggatcgagagcacgacgacgtcgaatgctgctggtgggagcgatggtggtgggcgcacagctcgccgtcgccgcgccgtcggtcggggctcccgccgacgacggaacgccggtggacgtgcagccggctactaccgtccccgcctggcccgaggccgaccgggggttctacgaaccaccggcggacgtggtcgcggcggccgagccgggcgaaatcatcgccgcccgcgaagtgcacctggcgaacctgtcggtgcttccggtgaacgtcgacgcgtggcagctgtcgtatcgctccaccaactcgcgggacgagccgatcccggcggtcgcgacggtcgtcaagccgcggggcacgatcgacggcgtccgcaatctgctctcgctccagccggaggaagactccctcggcaagtactgcgccgcttcgtacgcactgcagcagtggtccgtgcccgcgccgctgaccggtcagatcgtcgcgccgctgcagttcctcgaggcgcaggccgccctcgcccagggatgggccgtcgtgatgccggatcaccagggcccgaacgccgcgtatgcggccgggcccctcgcgggccgcatcaccctggacgggatccgggcggcggagaacttcggcccactgggcctgacaggcaggcagactccggtcgggttgatgggctattccggaggcgcgatcgcgacgggtcacgccgccgaactccacgcgagctacgcaccggacctgaacatcgtcggtgcggccgaaggcggcatcccggccgatctcggcgccctcgtcgatctcgccgacaacaacctgggcgcgggaatcgtgctgggcggcgtgttcggcgtgagccgtgattatcccgagctcgcggagtatctcgacacacatctgaatccactcggcaagcagctcctgaccgccaagagcaacctctgcgtgagctaccagtcggcgctcctgccgttcgcgaacctgcggggcctgttcgacagcccgagcggtgacccgctgcgcgatccggtggtcgagtcggtactcgaccggacgaagatgggtcaccgggtcccggacgtcccgatgttcatgtaccaggcgaacccggactggctggtgccggtcgggcccgtcgacacactcgtcgacacctactgccaggacccggacgcccgggtgacctacacccgcgaccacgccagcgagcacctgtccctcgaaccggtcgcggcggcgagcgccctgatgtggctgcgggaccggttcgccggggtcccggccgagaccggatgcagcacccacgacgtcggatcgatggccctcgaccaggcgacgtggccggtgtggtcgtcgatcgtcggcgacacgatcacgagcctgctcggtcagccgatcggcacgtga

SEQ ID NO: 156 - DNA, 990 bp, Rhodococcus sp.
atgagcactgcgacttacgaattctgcccgtcacccctcccggtgacgcggcgggagttcgccggagccagcctgcagtcgacggccctcgcccacacactccgacgcacggtccggccgttcctggacgggtgggcgcgctaccccgaactgccgtggcccacgggagtcgtcgacctgttcgggtactcgctcggtcccatccgcggaaccgtgcgcaggcccatccggctgccgcactgccgcgccgaatggatccggccgccgggtgagctcggcgaccgggcgatcctctacctccacggcggggcgttcctgtgctgcgggatcaactcccaccgccagatggtgtcccggatctcggcggagtcgcaggcgtcgacgctgaacgtcgcgtaccggatgatcccgcggaatcccatccgggcggccgtcgaggacggtgtcgacgggtaccggtggctgctctcgcacggctacaccgcagaccggatcgtcatcgccggcgactcggcgggcgggttcctgacgttcatggtgacgctcgaagcgctgcgccaggggttgccgcgtcccgccgccgacgtcgcgctgtcgccgctgaccgacctcgatccggtgaacaagctggcccatcccaacgccgacctctgcgctgtcttccccaaacgcgcggtcggtgccctgtccaggctgatcgaaaggctggacaccaggggcgggcacgagccgtccacgtcacccgtggacggctccctcgccgccatgccgccggcgctgatccagaccggctcgcaggaaatggtctacgtcgacgcggaactgatgtccgagcggctgtcccaggcgggtgtgccgtgcgaactgcaggtgtgggaacggcaggtgcacgtcttccaggccgccgccggactgctccccgagggcacccgcgccatccgcgagatcggccggttcatccgcaaggccacacccgtgagtacttcttaa

SEQ ID NO: 157 - protein, 386 aa, Acinetobacter sp ADP1
MAFRFIEGIPTSLGVFGVVGSLCMSHAHAIEAVQTSATITPTSPAACIGLESNSDRLACYDALFKVADTAKTTPVIEQKAALNPSPSVEQSELNPQSIKEKIGNLFAIEGPRIDPNTSLLDRRWELSEKSKLGTWNIRGYKPVYLLPIFWTSKKNEFPSSPNPENTVHENQNLTSAESKFQLSLKTKAWENIFGNNGDLWLGYTQSSRWQVYNADESRPFRETNYEPEASLIFRTNYEFLGLNGRLLGVTLNHQSNGRSDPLSRSWNRVIFNIGLERDNFALVLRPWIRIQEEAKNDNNPDIEDYVGRGDLTAFYRWKDNDFSLMLRHSLKDGDKSHGAVQFDWAFPISGKLRGNFQLFNGYGESLIDYNHRATYVGLGVSLMNWY

SEQ ID NO: 158 - protein, 289 aa, Escherichia coli
MRTLQGWLLPVFMLPMAVYAQEATVKEVHDAPAVRGSIIANMLQEHDNPFTLYPYDTNYLIYTQTSDLNKEAIASYDWAENARKDEVKFQLSLAFPLWRGILGPNSVLGASYTQKSWWQLSNSEESSPFRETNYEPQLFLGFATDYRFAGWTLRDVEMGYNHDSNGRSDPTSRSWNRLYTRLMAENGNWLVEVKPWYVVGNTDDNPDITKYMGYYQLKIGYHLGDAVLSAKGQYNWNTGYGGAELGLSYPITKHVRLYTQVYSGYGESLIDYNFNQTRVGVGVMLNDLF

SEQ ID NO: 159 - protein, 395 aa, Streptomyces coelicolor A3(2)
MTVVEPTPGADRVSIQRLRRRLERLIGVAATEGNELVALRNGDEIFPAMLGAIRAAEHTIDMMTFVYWRGQIARDFAAALADRARSGVRVRLLLDGFGAKEIEQDLLDAMEAAGVQIAWFRKPLWLSPFKQNHRCHRKALVIDEHTAFTGGVGIAEEWCGDARGPGEWRDTHVQVRGPAVDGVAAAFAQNWAECHDELYDDRDRFSDHTQPGTSIVQVVRGSASFGWQDMQTLIRVMLTSAEHRFRLATAYFAPDTYFIDLLCATARRGVTVEILLPGPHTDQRACQLAGQYHYTRLLDAGVSIREYQPTMMHAKIITVDGLAALIGSTNFNRRSMDHDEEIMLAVLDQEFTNGLDRDFDADLERSTAIEPTRWKRRATLRRLRETAVLPLRRFL

SEQ ID NO: 160 - protein, 148 aa, Arabidopsis thaliana
MAAPIILFSFLLFFSVSVSALNVGVQLIHPSISLTKECSRKCESEFCSVPPFLRYGKYCGLLYSGCPGERPCDGLDSCCMKHDACVQSKNNDYLSQECSQKFINCMNNFSQKKQPTFKGNKCDADEVIDVISIVMEAALIAGKVLKKP

SEQ ID NO: 161 - protein, 357 aa, Arabidopsis thaliana
MEYQGLQNWDGLLDPLDDNLRREILRYGQFVESAYQAFDFDPSSPTYGTCRFPRSTLLERSGLPNSGYRLTKNLRATSGINLPRWIEKAPSWMATQSSWIGYVAVCQDKEEISRLGRRDVVISFRGTATCLEWLENLRATLTHLPNGPTGANLNGSNSGPMVESGFLSLYTSGVHSLRDMVREEIARLLQSYGDEPLSVTITGHSLGAAIATLAAYDIKTTFKRAPMVTVISFGGPRVGNRCFRKLLEKQGTKVLRIVNSDDVITKVPGVVLENREQDNVKMTASIMPSWIQRRVEETPWVYAEIGKELRLSSRDSPHLSSINVATCHELKTYLHLVDGFVSSTCPFRETARRVLHR

SEQ ID NO: 162 - protein, 471 aa, Arabidopsis thaliana
MAAKVFTQNPIYSQSLVRDKTPQQKHNLDHFSISQHTSKRLVVSSSTMSPPISSSPLSLPSSSSSQAIPPSRAPAVTLPLSRVWREIQGSNNWENLIEPLSPILQQEITRYGNLLSASYKGFDLNPNSKRYLSCKYGKKNLLKESGIHDPDGYQVTKYIYATPDINLNPIKNEPNRARWIGYVAVSSDESVKRLGRRDILVTFRGTVTNHEWLANLKSSLTPARLDPHNPRPDVKVESGFLGLYTSGESESKFGLESCREQLLSEISRLMNKHKGEEISITLAGHSMGSSLAQLLAYDIAELGMNQRRDEKPVPVTVFSFAGPRVGNLGFKKRCEELGVKVLRITNVNDPITKLPGFLFNENFRSLGGVYELPWSCSCYTHVGVELTLDFFDVQNISCVHDLETYITLVNRPRCSKLAVNEDNFGGEFLNRTSELMFSKGRRQALHFTNAATNAAYLLCSISNHMLYYNIF

SEQ ID NO: 163 - protein, 410 aa, Arabidopsis thaliana
SPSKKNKPPSCGSLVTILSLDGGGVRGIIAGVILAFLEKQLQELDGEEARLADYFDVIAGTSTGGLVTAMLTVPDETGRPHFAAKDIVPFYLEHCPKIFPQPTGVLALLPKLPKLLSGPKYSGKYLRNLLSKLLGETRLHQTLTNIVIPTFDIKKLQPTIFSSYQLLVDPSLDVKVSDICIGTSAAPTFFPPHYFSNEDSQGNKTEFNLVDGAVTANNPTLVAMTAVSKQIVKNNPDMGKLKPLGFDRFLVISIGTGSTKREEKYSAKKAAKWGIISWLYDDGSTPILDITMESSRDMIHYHSSVVFKALQSEDKYLRIDDDTLEGDVSTMDLATKSNLENLQKIGEKMLTNRVMQMNIDTGVYEPVAENITNDEQLKRYAKILSDERKLRRLRSDTMIKDSSNESQEIK

SEQ ID NO: 164 - protein, 686 aa, Anabaena variabilis ATCC 29413
MINLANTQTVLKFDGIDDYIDFGKNDIGGVFAQGSSCFTVSGWINPHKLTEKSTSYGTRNVFFARSSDRYSDNFEFGISETGSLDIFIDETISKGIRTFGNGELTIGQWHFFAIVFNSGQITVYLDDHEYNDSLRGSSLNKATSSVTLGATLHKQVYFTGQLANISVWNYPCTQVQIKTHHCGLIVGDEPGLVAYWKLDEGQGTTVKNKAGKSYQGNFRGNPSWDLAQIPFAAPLSSQDDIQEDVQFEIGIIAETSISTLTTDLLAATVPLVSNNEDQTIEIQYPEINSEKSEIIANLINLPSHEEASKTDQTEVLVNSQQLQTFIQAESPETMNTKSRPRYKILSIDGGGIRGIIPALLLAEIERRTQEPIFSLFDLIAGTSSGGILALGLTKPRLNSSEELPLAEYTAEDLVQLFLEYGVEIFYEPLFERLLGPLEDIFLQPKYPSTSKEEILRQYLGKTPLVNNLKEVFVTSYDIEQRIPVFFTNQLEKQQIESKNSHNLCGNVSLLDAALATSATPTYFAPHRIVSPENSAIAYTLIDGGVFANNPAHLAILEAQISSKRKAQTVLNQEDILVVSLGTGSPTSAYPYKEVKNWGLLQWGRPLLNIVFDGGSGVVSGELEQLFEPSDKEAKSFYYRFQTLLDAELEAIDNTKLQNTRQLQAIAHKLISEKSQQIDELCELLLG

SEQ ID NO: 165 - protein, 664 aa, Saccharomyces cerevisiae S288c
MKLQSLLVSAAVLTSLTENVNAWSPNNSYVPANVTCDDDINLVREASGLSDNETEWLKKRDAYTKEALHSFLNRATSNFSDTSLLSTLFGSNSSNMPKIAVACSGGGYRAMLSGAGMLAAMDNRTDGANEHGLGGLLQGATYLAGLSGGNWLTSTLAWNNWTSVQAIVDNTTESNSIWDISHSILTPDGINIFKTGSRWDDISDDVQDKKDAGFNISLADVWGRALAYNFWPSLHRGGVGYTWSTLREADVFKNGEMPFPITVADGRYPGTTVINLNATLFEFNPFEMGSWDPTLNAFTDVKYLGTNVTNGKPVNKGQCIAGFDNTGFITATSSTLFNQFLLRLNSTDLPSFIANLATDFLEDLSDNSDDIAIYAPNPFKEANFLQKNATSSIIESEYLFLVDGGEDNQNIPLVPLLQKERELDVIFALDNSADTDDYWPDGASLVNTYQRQFGSQGLNLSFPYVPDVNTFVNLGLNKKPTFFGCDARNLTDLEYIPPLIVYIPNSRHSFNGNQSTFKMSYSDSERLGMIKNGFEAATMGNFTDDSDFLGCVGCAIIRRKQQNLNATLPSECSQCFTNYCWNGTIDSRSVSGVGNDDYSSSASLSASAAAASASASASASASASASGSSTHKKNAGNALVNYSNLNTNTFIGVLSVISAVFGLI

SEQ ID NO: 166 - protein, 706 aa, Saccharomyces cerevisiae S288c
MQLRNILQASSLISGLSLAADSSSTTGDGYAPSIIPCPSDDTSLVRNASGLSTAETDWLKKRDAYTKEALHSFLSRATSNFSDTSLLSTLFSSNSSNVPKIGIACSGGGYRAMLGGAGMIAAMDNRTDGANEHGLGGLLQSSTYLSGLSGGNWLTGTLAWNNWTSVQEIVDHMSESDSIWNITKSIVNPGGSNLTYTIERWESIVQEVQAKSDAGFNISLSDLWARALSYNFFPSLPDAGSALTWSSLRDVDVFKNGEMPLPITVADGRYPGTTVINLNATLFEFTPFEMGSWDPSLNAFTDVKYLGTNVTNGKPVNKDQCVSGYDNAGFVIATSASLFNEFSLEASTSTYYKMINSFANKYVNNLSQDDDDIAIYAANPFKDTEFVDRNYTSSIVDADDLFLVDGGEDGQNLPLVPLIKKERDLDVVFALDISDNTDESWPSGVCMTNTYERQYSKQGKGMAFPYVPDVNTFLNLGLTNKPTFFGCDAKNLTDLEYIPPLVVYIPNTKHSFNGNQSTLKMNYNVTERLGMIRNGFEAATMGNFTDDSNFLGCIGCAIIRRKQESLNATLPPECTKCFADYCWNGTLSTSANPELSGNSTYQSGAIASAISEATDGIPITALLGSSTSGNTTSNSTTSTSSNVTSNSNSSSNTTLNSNSSSSSISSSTARSSSSTANKANAAAISYANTNTLMSLLGAITALFGLI

SEQ ID NO: 167 - protein, 211 aa, Acinetobacter sp. ADP1
MQLYNMFLDGKWAKWFLIGSFSVIPFTVSAKTILILGDSLSAGYGINPEQGWVALLQKRLDQQFPKQHKVINASVSGETTSGALARLPKLLTTYRPNVVVIELGGNDALRGQPPQMIQSNLEKLIQHSQKAKSKVVVFGMKIPPNYGTAYSQAFENNYKVVSQTYQVKLLPFFLDGVAGHKSLMQNDQIHPNAKAQSILLNNAYPYIKGAL

SEQ ID NO: 168 - protein, 342 aa, Acinetobacter sp. ADP1
MSDIPFLNPTILQQLDLPVPSRDQTPLVLPQLNLNHSFEPSRDLLAYRKLYGLDLLAGDYWQGYIQMPLFRLHVQVFTPEREIPLGTVCLLHGYLEHSGIYQPIIREILDQGFSVVTYDLPGHGLSDGSPANIQNFDHYQQVLMAVYQYVKNADQLPKPWLGIGQSTGGAIWMHHLLEYAEKRQDPIVDRVLLLSPLIRPAKTAWWHNSVGLGIIRRIRRQVPRHFRRNNHNPEFLRFIRLKDPLQPRMMGMDWILAMSKWMFEMEQRPACRIPVWLAQGALDQTVDWRYNIEFIRRKFRLQTLLMLEEGSHQLINERADIRAALTGLIPAFLHARPKHHYY

SEQ ID NO: 169 - protein, 279 aa, Rhodococcus jostii RHA1
MQHRESSFAGVGGIPIVYDVWLPERRPRGVLVLCHGFGEHARRYDHVIERLGELDLAIYAPDHRGHGRSGGKRVHLKDWTEFTDDLHQLFGIASTDWPGTDRFLLGHSMGGSIALTYALDHQQDLKALMLSGPAVDVTSGTPRIVVEIGKLVGRFLPGVPVESLDAKLVSRDPAVVSAYEEDPLVHHGKVPAGIARGMILAAERLPERLPSLTIPLLLQHGQDDGLASVHGTELIAEYVGSEDLTVEIYENLFHEVFNEPENEEVLDDLVEWLRPRVQA

SEQ ID NO: 170 - protein, 825 aa, Arabidopsis thaliana
MDISNEASVDPFSIGPSSIMGRTIAFRVLFCRSMSQLRRDLFRFLLHWFLRFKLTVSPFVSWFHPRNPQGILAVVTIIAFVLKRYTNVKIKAEMAYRRKFWRNMMRTALTYEEWAHAAKMLEKETPKMNESDLYDEELVKNKLQELRHRRQEGSLRDIMFCMRADLVRNLGNMCNSELHKGRLQVPRHIKEYIDEVSTQLRMVCNSDSEELSLEEKLSFMHETRHAFGRTALLLSGGASLGAFHVGVVRTLVEHKLLPRIIAGSSVGSIICAVVASRSWPELQSFFENSLHSLQFFDQLGGVFSIVKRVMTQGALHDIRQLQCMLRNLTSNLTFQEAYDMTGRILGITVCSPRKHEPPRCLNYLTSPHVVIWSAVTASCAFPGLFEAQELMAKDRSGEIVPYHPPFNLDPEVGTKSSSGRRWRDGSLEVDLPMMQLKELFNVNHFIVSQANPHIAPLLRLKDLVRAYGGRFAAKLAHLVEMEVKHRCNQVLELGFPLGGLAKLFAQEWEGDVTVVMPATLAQYSKIIQNPTHVELQKAANQGRRCTWEKLSAIKSNCGIELALDDSVAILNHMRRLKKSAERAATATSSSHHGLASTTRFNASRRIPSWNVLARENSTGSLDDLVTDNNLHASSGRNLSDSETESVELSSWTRTGGPLMRTASANKFIDFVQSLDIDIALVRGFSSSPNSPAVPPGGSFTPSPRSIAAHSDIESNSNSNNLGTSTSSITVTEGDLLQPERTSNGFVLNVVKRENLGMPSIGNQNTELPESVQLDIPEKEMDCSSVSEHEEDDNDNEEEHNGSSLVTVSSEDSGLQEPVSGSVIDA

SEQ ID NO: 171 - protein, 501 aa, Acinetobacter sp. ADP1
MLGIKKSDMNPYQAHRIKKLKYQLENAESYEEWKSTALQLDEETGLQEWKYDNCSAYFDAELISYRLNLLRKYRLQQRVMDSVYLLQEGLTHDIANIGHPMLFAATYVGTKQIIEDYIEEVSLSLAFIAASQCQTLTVAEKLKFFKNCQKTYGQPALMFSGGATLGLFHSGVCKTLIQQDLMPRVLSGSSAGAIMAGMLGTSTASEFQKILLGENFFSEAFHFRGVRDLLKGNGGFADVKYLKKFLIENLGDLTFSEAYERSGLHINVAVAPYDGSQNARILNAYTAPNLLVWSAVLASCAVPVLFPPVRLTSKKRDGSHTPYMANTKWVDGSVRSDFPQEKMARLYNLNYTIASQVNPHVVPFMQSDASRYRKDILSWPQRILRRQGKVISLGIMDFTRERLGNVPPVRRLLDHGYGIVGQRYYGDVNIIAPFNLRQYAYMLQNPRPHLFKLLQQQGERATWPKISAIETHARIGKTIQHCIEVLDYQKNRYIQAEKASA

SEQ ID NO: 172 - protein, 910 aa, Saccharomyces cerevisiae S288c
MSSKISDLTSTQNKPLLVTQQLIEKYYEQILGTSQNIIPILNPKNKFIRPSKDNSDVERVEEDAGKRLQTGKNKTTNKVNFNLDTGNEDKLDDDQETVTENENNDIEMVETDEGEDERQGSSLASKCKSFLYNVFVGNYERDILIDKVCSQKQHAMSFEEWCSAGARLDDLTGKTEWKQKLESPLYDYKLIKDLTSRMREERLNRNYAQLLYIIRTNWVRNLGNMGNVNLYRHSHVGTKYLIDEYMMESRLALESLMESDLDDSYLLGILQQTRRNIGRTALVLSGGGTFGLFHIGVLGTLFELDLLPRVISGSSAGAIVASILSVHHKEEIPVLLNHILDKEFNIFKDDKQKSESENLLIKISRFFKNGTWFDNKHLVNTMIEFLGDLTFREAYNRTGKILNITVSPASLFEQPRLLNNLTAPNVLIWSAVCASCSLPGIFPSSPLYEKDPKTGERKPWTGSSSVKFVDGSVDNDLPISRLSEMFNVDHIIACQVNIHVFPFLKLSLSCVGGEIEDEFSARLKQNLSSIYNFMANEAIHILEIGSEMGIAKNALTKLRSVLSQQYSGDITILPDMCMLFRIKELLSNPTKEFLLREITNGAKATWPKVSIIQNHCGQEFALDKAISYIKGRMIVTSSLKTPFQFADSVIGLIKAPEQTSDESKNPENSTLLTRTPTKGDNHISNVLDDNLLESESTNSLLLLRENASTYGRSPSGFRPRYSITSASLNPRHQRRKSDTISTSRRPAKSFSFSVASPTSRMLRQSSKINGHPPPILQKKTSMGRLMFPMDAKTYDPESHELIPHSASIETPAMVDKKLHFGRKSRYLRHMNKKWVSSSNILYTDSDKEDHPTLRLISNFDSDAMIHSDLAGNFRRHSIDGRPPSQATKSSPFRSRPSSSTQHKSTTSFTQ

SEQ ID NO: 173 - protein, 470 aa, Rhodococcus jostii RHA1
MIGSRARRRRMLLVGAMVVGAQLAVAAPSVGAPADDGTPVDVQPATTVPAWPEADRGFYEPPADVVAAAEPGEIIAAREVHLANLSVLPVNVDAWQLSYRSTNSRDEPIPAVATVVKPRGTIDGVRNLLSLQPEEDSLGKYCAASYALQQWSVPAPLTGQIVAPLQFLEAQAALAQGWAVVMPDHQGPNAAYAAGPLAGRITLDGIRAAENFGPLGLTGRQTPVGLMGYSGGAIATGHAAELHASYAPDLNIVGAAEGGIPADLGALVDLADNNLGAGIVLGGVFGVSRDYPELAEYLDTHLNPLGKQLLTAKSNLCVSYQSALLPFANLRGLFDSPSGDPLRDPVVESVLDRTKMGHRVPDVPMFMYQANPDWLVPVGPVDTLVDTYCQDPDARVTYTRDHASEHLSLEPVAAASALMWLRDRFAGVPAETGCSTHDVGSMALDQATWPVWSSIVGDTITSLLGQPIGT

SEQ ID NO: 174 - protein, 329 aa, Rhodococcus sp.
MSTATYEFCPSPLPVTRREFAGASLQSTALAHTLRRTVRPFLDGWARYPELPWPTGVVDLFGYSLGPIRGTVRRPIRLPHCRAEWIRPPGELGDRAILYLHGGAFLCCGINSHRQMVSRISAESQASTLNVAYRMIPRNPIRAAVEDGVDGYRWLLSHGYTADRIVIAGDSAGGFLTFMVTLEALRQGLPRPAADVALSPLTDLDPVNKLAHPNADLCAVFPKRAVGALSRLIERLDTRGGHEPSTSPVDGSLAAMPPALIQTGSQEMVYVDAELMSERLSQAGVPCELQVWERQVHVFQAAAGLLPEGTRAIREIGRFIRKATPVSTS

SEQ ID NO: 175 - DNA, 2733 bp, Saccharomyces cerevisiae S288c
atgagcagcaaaatatcagatcttacatctacacaaaataagcccctccttgttacgcaacaactaatcgaaaaatattacgaacagatcctgggcacttcccagaacataattcctattttaaatccgaagaacaagtttattaggcccagtaaggataattcagatgttgaaagggtggaggaggatgctggtaaaagactgcaaactggcaagaacaaaactacgaacaaagtaaatttcaacctggatactggaaacgaggataaacttgacgatgaccaagagacagtaacagaaaatgaaaataatgatatcgagatggttgagacagacgaaggcgaagatgaaaggcaagggtcatctttagccagtaaatgcaaatcatttctttacaacgtttttgtgggaaactatgaaagagacattcttattgacaaagtctgttcacaaaagcaacatgcgatgtcatttgaagaatggtgttctgcgggcgccagattggatgacctcactgggaaaacagaatggaagcagaaattggaaagtcccttgtatgattacaagctaataaaagatttaacatctagaatgcgtgaggagcgcttgaataggaattacgctcaattgttgtacatcattaggacgaattgggtacgaaacctgggaaatatggggaatgtaaacctatataggcactcccatgtaggcaccaaatatttaattgacgagtatatgatggagtctaggttagcgctagaatctttaatggagtctgatcttgatgatagttaccttttgggtatactgcaacaaacgagaagaaatattggtcgtaccgctttagttctcagtgggggtggaacttttggtcttttccacatcggtgtccttggtactctatttgaattggatttattacccagagtgattagtggtagcagtgctggtgcaattgtagcaagcatattatctgtccatcacaaagaagaaattccggttttactaaatcatattttggataaagaattcaacattttcaaagacgataaacagaaaagtgaaagcgagaatttgttaataaaaatatctaggttcttcaaaaacggtacgtggtttgataacaagcatctggtaaatacaatgatagaatttttgggagatttgacatttagggaagcttacaatagaacgggtaaaattttgaatataaccgtttcgccggcatctttatttgaacaaccgcgcttgctgaataatttgactgcaccaaacgtcctgatttggtccgccgtatgtgcatcatgttcactaccgggaattttcccctcgagcccactttacgaaaaagatccaaaaacgggagaaaggaaaccatggactggtagtagttcggtcaaatttgtcgatggttctgtggacaatgacttgcccatttctcgtctttctgaaatgtttaatgtagaccatattatcgcatgccaggtgaatattcacgtatttccctttttgaaactatcactatcctgtgttggcggggaaattgaggacgaatttagtgcaagattaaagcaaaacttatcaagtatatacaattttatggccaatgaagctattcatattctagaaattggaagtgagatgggaattgccaaaaacgcgcttacaaaactgagatcggtattatctcaacaatattctggtgacatcactattttgcccgacatgtgtatgctttttagaataaaggagctgttgtcaaacccaacaaaagaatttttattaagggaaatcaccaatggtgcaaaagctacgtggcccaaggtttccattattcaaaatcactgtggccaggaatttgctctggataaggcgatttcttatatcaaaggtaggatgattgtcacctcctctttaaaaacccccttccaatttgctgattcagtcattggattaattaaagctccagagcaaacgtcagatgagtccaaaaacccagaaaattcaacattgctaactaggactccaaccaagggtgacaatcatatttccaatgttttagatgacaacttattagaatcagaatcgacaaactctttgctattgttacgtgagaatgcaagcacatatgggcggtcaccttccgggtttagaccgcggtattccattacgtccgcttctctcaatccgcgtcaccaaagaaggaaatcagatactatttcaacttcaaggcgaccagccaaatccttttcattttcagttgcttctcccacatcaaggatgttgaggcaatccagcaaaatcaatggacacccaccgccaattctgcagaaaaaaacaagtatgggccggctaatgtttcctatggatgccaagacctatgacccggaaagccatgaacttatcccacattctgccagcattgaaacacctgccatggtagacaagaaattgcattttggccgaaagagtagatacttgaggcatatgaacaaaaaatgggtcagcagtagcaacatattatacacagattcggataaagaagaccatcctacattgagactgataagtaacttcgattcagacgcaatgattcatagtgatttagcgggcaatttcaggcgtcatagcattgatggaagacccccttctcaagctacaaagagctcaccgtttcgatcgaggccttcttcttcaacgcagcacaaaagcaccaccagttttactcaataa

SEQ ID NO: 176 - protein, 401 aa, Bacillus subtilis subtilis 168
MLRGTYLFGYAFFFTVGIIHISTGSLTPFLLEAFNKTTDDISVIIFFQFTGFLSGVLIAPLMIKKYSHFRTLTLALTIMLVALSIFFLTKDWYYIIVMAFLLGYGAGTLETTVGSFVIANFESNAEKMSKLEVLFGLGALSFPLLINSFIDINNWFLPYYCIFTFLFVLFVGWLIFLSKNREYAKNANQQVTFPDGGAFQYFIGDRKKSKQLGFFVFFAFLYAGIETNFANFLPSIMINQDNEQISLISVSFFWVGIIIGRILIGFVSRRLDFSKYLLFSCSCLIVLLIAFSYISNPILQLSGTFLIGLSIAGIFPIALTLASIIIQKYVDEVTSLFIASASFGGAIISFLIGWSLNQDTILLTMGIFTTMAVILVGISVKIRRTKTEDPISLENKASKTQ

SEQ ID NO: 177 - protein, 472 aa, Streptomyces coelicolor
MASTSQAPSPGAGTAHPDHLGHVIFIAAAAAMGGFLFGYDSSVINGAVEAIRDRYDVGSAVLAQVIAVALIGCAIGAATAGRIADRIGRIRCMQIAAVLFTVSAVGSALPFALWDLAMWRIIGGFAIGMASVIGPAYIAEVSPPAYRGRLGSFQQAAIVIGIAVSQLVNWGLLNAAGGDQRGELMGLEAWQVMLGVMVIPAVLYGLLSFAIPESPRFLISVGKRERAKKILEEVEGKDVDFDARVTEIEHAMHREEKSSFKDLLGGSFFFKPIVWIGIGLSVFQQFVGINVAFYYSSTLWQSVGVDPADSFFYSFTTSIINIVGTVIAMIFVDRVGRKPLALIGSVGMVIGLALEAWAFSFDLVDGKLPATQGWVALIAAHVFVLFFALSWGVVVWVFLGEMFPNRIRAAALGVAASAQWIANWAITASFPSLADWNLSGTYVIYTIFAALSIPFVLKFVKETKGKALEEMG

SEQ ID NO: 178 - protein, 472 aa, Streptomyces coelicolor A3; identical to SEQ ID NO: 177

SEQ ID NO: 179 - protein, 498 aa, Mycobacterium smegmatis  MC2 155
MNVIGITLLPRGRIMSHGPVSDDTPSIFGDDDQAASSGRTAVRIAAVAALGGLLFGYDSAVINGAVDSIQEDFGIGNYALGLAVASALLGAAAGALSAGRIADRIGRIAVMKIAAVLFFISAFGTGFAPETVTLVVFRIVGGIGVGVASVIAPAYIAETSPPGIRGRLGSLQQLAIVLGIFTSFVVNWLLQWAAGGPNEVLAMGLDAWRWMFLAMAVPAVLYGALAFTIPESPRYLVATHKIPEARRVLSMLLGQKNLEITITRIRDTLEREDKPSWRDLKKPTGGIYGIVWVGLGLSIFQQFVGINVIFYYSNVLWQAVGFSADQSAIYTVITSVVNVLTTLIAIALIDKIGRKPLLLIGSSGMAVTLATMAVIFANATVKPDGTPDLPGASGLIALIAANLFVVAFGMSWGPVVWVLLGEMFPNRFRAAALGLAAAGQWAANWLITVSFPELRNHLGLAYGFYALCAVLSFLFVSKWVEETRGKNLEDMHAEALGH

SEQ ID NO: 180 - DNA, 1647 bp, Lactococcus lactis
atgtatacagtaggagattacctattagaccgattacacgagttaggaattgaagaaatttttggagtccctggagactataacttacaatttttagatcaaattatttcccgcaaggatatgaaatgggtcggaaatgctaatgaattaaatgcttcttatatggctgatggctatgctcgtactaaaaaagctgccgcatttcttacaacctttggagtaggtgaattgagtgcagttaatggattagcaggaagttacgccgaaaatttaccagtagtagaaatagtgggatcacctacatcaaaagtccaaaatgaaggaaaatttgttcatcatacgctggctgacggtgattttaaacactttatgaaaatgcacgaacctgttacagcagctcgaactttactgacagcagaaaatgcaaccgttgaaattgaccgagtactttctgcactactaaaagaaagaaaacctgtctatatcaacttaccagttgatgttgctgctgcaaaagcagagaaaccctcactccctttgaaaaaagaaaatccaacttcaaatacaagtgaccaagagattttgaataaaattcaagaaagcttgaaaaatgccaaaaaaccaatcgtgattacaggacatgaaataattagctttggcttagaaaatacagtcactcaatttatttcaaagacaaaactccctattacgacattaaactttggaaaaagttcagttgatgaaactctcccttcatttttaggaatctataatggtaaactctcagagcctaatcttaaagaattcgtggaatcagccgacttcatcctgatgcttggagttaaactcacagactcttcaacaggagcatttacccatcatttaaatgaaaataaaatgatttcactgaacatagacgaaggaaaaatatttaacgaaagcatccaaaattttgattttgaatccctcatctcctctctcttagacctaagcggaatagaatacaaaggaaaatatatcgataaaaagcaagaagactttgttccatcaaatgcgcttttatcacaagaccgcctatggcaagcagttgaaaacctaactcaaagcaatgaaacaatcgttgctgaacaagggacatcattctttggcgcttcatcaattttcttaaaaccaaagagtcattttattggtcaacccttatggggatcaattggatatacattcccagcagcattaggaagccaaattgcagataaagaaagcagacaccttttatttattggtgatggttcacttcaacttacagtgcaagaattaggattagcaatcagagaaaaaattaatccaatttgctttattatcaataatgatggttatacagtcgaaagagaaattcatggaccaaatcaaagctacaatgatattccaatgtggaattactcaaaattaccagaatcatttggagcaacagaagaacgagtagtctcgaaaatcgttagaactgaaaatgaatttgtgtctgtcatgaaagaagctcaagcagatccaaatagaatgtactggattgagttagttttggcaaaagaagatgcaccaaaagtactgaaaaaaatgggtaaactatttgctgaacaaaataaatcataa

SEQ ID NO: 181 - protein, 548 aa, Lactococcus lactis
MYTVGDYLLDRLHELGIEEIFGVPGDYNLQFLDQIISRKDMKWVGNANELNASYMADGYARTKKAAAFLTTFGVGELSAVNGLAGSYAENLPVVEIVGSPTSKVQNEGKFVHHTLADGDFKHFMKMHEPVTAARTLLTAENATVEIDRVLSALLKERKPVYINLPVDVAAAKAEKPSLPLKKENPTSNTSDQEILNKIQESLKNAKKPIVITGHEIISFGLENTVTQFISKTKLPITTLNFGKSSVDETLPSFLGIYNGKLSEPNLKEFVESADFILMLGVKLTDSSTGAFTHHLNENKMISLNIDEGKIFNESIQNFDFESLISSLLDLSGIEYKGKYIDKKQEDFVPSNALLSQDRLWQAVENLTQSNETIVAEQGTSFFGASSIFLKPKSHFIGQPLWGSIGYTFPAALGSQIADKESRHLLFIGDGSLQLTVQELGLAIREKINPICFIINNDGYTVEREIHGPNQSYNDIPMWNYSKLPESFGATEERVVSKIVRTENEFVSVMKEAQADPNRMYWIELVLAKEDAPKVLKKMGKLFAEQNKS

SEQ ID NO: 182 - DNA, 1164 bp, Escherichia coli
atgaacaactttaatctgcacaccccaacccgcattctgtttggtaaaggcgcaatcgctggtttacgcgaacaaattcctcacgatgctcgcgtattgattacctacggcggcggcagcgtgaaaaaaaccggcgttctcgatcaagttctggatgccctgaaaggcatggacgtgctggaatttggcggtattgagccaaacccggcttatgaaacgctgatgaacgccgtgaaactggttcgcgaacagaaagtgactttcctgctggcggttggcggcggttctgtactggacggcaccaaatttatcgccgcagcggctaactatccggaaaatatcgatccgtggcacattctgcaaacgggcggtaaagagattaaaagcgccatcccgatgggctgtgtgctgacgctgccagcaaccggttcagaatccaacgcaggcgcggtgatctcccgtaaaaccacaggcgacaagcaggcgttccattctgcccatgttcagccggtatttgccgtgctcgatccggtttatacctacaccctgccgccgcgtcaggtggctaacggcgtagtggacgcctttgtacacaccgtggaacagtatgttaccaaaccggttgatgccaaaattcaggaccgtttcgcagaaggcattttgctgacgctaatcgaagatggtccgaaagccctgaaagagccagaaaactacgatgtgcgcgccaacgtcatgtgggcggcgactcaggcgctgaacggtttgattggcgctggcgtaccgcaggactgggcaacgcatatgctgggccacgaactgactgcgatgcacggtctggatcacgcgcaaacactggctatcgtcctgcctgcactgtggaatgaaaaacgcgataccaagcgcgctaagctgctgcaatatgctgaacgcgtctggaacatcactgaaggttccgatgatgagcgtattgacgccgcgattgccgcaacccgcaatttctttgagcaattaggcgtgcctacccacctctccgactacggtctggacggcagctccatcccggctttgctgaaaaaactggaagagcacggcatgacccaactgggcgaaaatcatgacattacgttggatgtcagccgccgtatatacgaagccgcccgctaa

SEQ ID NO: 183 - protein, 387 aa, Escherichia coli
MNNFNLHTPTRILFGKGAIAGLREQIPHDARVLITYGGGSVKKTGVLDQVLDALKGMDVLEFGGIEPNPAYETLMNAVKLVREQKVTFLLAVGGGSVLDGTKFIAAAANYPENIDPWHILQTGGKEIKSAIPMGCVLTLPATGSESNAGAVISRKTTGDKQAFHSAHVQPVFAVLDPVYTYTLPPRQVANGVVDAFVHTVEQYVTKPVDAKIQDRFAEGILLTLIEDGPKALKEPENYDVRANVMWAATQALNGLIGAGVPQDWATHMLGHELTAMHGLDHAQTLAIVLPALWNEKRDTKRAKLLQYAERVWNITEGSDDERIDAAIAATRNFFEQLGVPTHLSDYGLDGSSIPALLKKLEEHGMTQLGENHDITLDVSRRIYEAAR

SEQ ID NO: 184 - protein, 172 aa, Synechococcus elongatus PCC7942
MKRTLSVLVEDEAGVLTRIAGLFARRSFNIESLAVGPAEQVGISRITMVVQGDDREIEQITKQLYKLINVLKVQDISEVPCVERELMLIKVNANSSNRSEILELVQIFRARVVDVAEDSLIVEVVGDPGKMVAIVQVLQRFGIREISRTGKVALTRESGVNTEFLKALEARV

SEQ ID NO: 185 - protein, 612 aa, Synechococcus elongatus PCC7942
MQLQTVTIQQRATGAYALIDSLCQHGVKHIFGYPGGAILPIYDELHRAEAAGRVQHILVRHEQGAVHAADAYSRATGEVGVCFATSGPGATNLVTGIATAQMDSIPMVVVTGQVPRTAIGTDAFQETDIYGITLPIVKHSYVVRDPRDMARIVAEAFHIAQSGRPGPVLIDVPKDVGTEEFDYVPVAPGDIRLPGYRPTTRGNPRQIAQAIALVKVARRPLLYVGGGAITAGAHAELRAFAERFQLPVTTTLMGKGAFDERHPLALGMLGMHGTAYANFAVSECDLLIAVGARFDDRVTGKLDEFASKAQVIHVDIDPAEVGKNRVPEVPIVGDVRQVLNELLARAEEQISADDATRTQPWLDRIAYWKREYPLQIPYYADVLSPQQVIHSLGEAAPDAYFTTDVGQHQMWAAQFIKNGPRRWISSAGLGTMGFGMPAAMGAQMALPDDTVICVAGDASILMNIQELGTLAQYNIPIKVVVVNNGWQGMVRQWQEAFYDERYSNSNMERGMPDFVKLAEAFGIKGMRVSHPDELQAAIAEMLAFDGPVFLDAIVKRDENCYPMVPSGHSNAQMLGLPKDPTLDLDLAIATCSSCGAKTLPSHKFCPDCGAKL

SEQ ID NO: 186 - protein, 327 aa, Synechococcus elongatus PCC7942
MYYDADANLDLLNGKTVAIIGYGSQGHAHALNLRDSGVNVVVGLYPGSKSAAKAEAEGLKVLPVAEAAQAADWIMILLPDEFQKSVFENEIRPALSAGKVLAFAHGFNIHFAQIVPPADVDVVMIAPKSPGHLVRRTYEQGQGVPCLFAIYQDASGQARDRAMAYAKGIGGTRAGILETSFREETETDLFGEQAVLCGGLSALIKAGFETLVEAGYQPELAYFECLHEVKLIVDLIVEGGLAAMRDSISNTAEYGDYVTGPRLITEETKAEMKRVLADIQQGRFALDFVQECGAGKPVMTATRRLEAEHPIESVGKDLRAMFSWLKK

SEQ ID NO: 187 - protein, 619 aa, Synechococcus elongatus PCC7942
MPQYRSRTTTYGRNMAGARALWRATGMKDEDFEKPIIAVANSFTQFVPGHVHLKDLGQLVAREIERAGGVAKEFNTIAVDDGIAMGHGGMLYSLPSRDLIADSVEYMVNAHCADALVCISNCDKITPGMLMAALRLNIPAVFVSGGPMEAGKVILNGEERHLDLVDAMVVAADDRESDEDVATIERSACPTCGSCSGMFTANSMNCLTEALGLSLPGNGSLLATHGDRKELFLEAGRLAVKLAKQYYEQDDESVLPRSIASFKAFENAICLDIAMGGSTNTVLHLLAAAHEAGVDFTMKDIDRLSRKIPNLCKVAPSTQKYHMEDVHRAGGVIAILGELDRAGLLHREVPTVHSPSLGAALDQWDINRETATEEAKSRYLAAPGGVPTQEAFSQSKRWTALDLDRENGCIRDIEHAYSQDGGLAVLYGNLAEQGCIVKTAGVDENILVFSGPAVVCESQDEAVNWILNGRVKEGDVVLIRYEGPRGGPGMQEMLYPTSYLKSKGLGKACALITDGRFSGGTSGLSIGHVSPEAAEGGLIALVEQGDRIEIDIPNRRIHLAVSEEELAHRRAAMEARGDQAWTPKDRDRPISQALQAYAAMTTSAARGGVRDLSQILGSR

SEQ ID NO: 188 - protein, 542 aa, Synechococcus elongatus PCC7942
MTRPASAAIAVYDTTLRDGAQREGLSLSLEDKLRIAHCLDRLGVKFIEGGWPGANPKDVQFFWELQQRPLQQAEVVAFCSTRRPGQIAGEDELLKALLAAGTTWVTIFGKSWDLHVVEGLKTSLDENLVMISDSIAYLRTCDRRVIYDAEHWFDGYLANPDYALQTLAAAIEAGAEWIVLCDTNGGCLPHQISEIVAAVLDRFPSLAPDQTGPQLGIHTHNDSETAVANAIAAVQAGARMVHGTINGYGERCGNANLCSVIPNLQLKLGYDCVETEQLMQLTATSRLVSEIVNLAPDDHAAYVGQSAFAHKGGIHVSAVERNPLTYEHIRPEQVGNLRRIVISEQSGLSNVLAKARSFGLDLQRNDPACRDLLARLKELESQGYQFEAAEASFDLLMREATGDRPHFFDLKDFHVHCSKQRQELNALATVKVAVTGRDILESAEGNGPVSALDAALRKAIGSFYPAVMQFHLSDYKVRILDGAAGTSAKTRVLVESSNGSQRWSTVGVSGNIIEASYQAVVEGIEYGLLLQQQAPLQAAEKP

SEQ ID NO: 189 - protein, 540 aa, Synechococcus elongatus PCC7942
MASASSNDRILIFDTTLRDGEQSPGASLNLEEKLAIARQLARLNVDIIEAGFAFASPGDFEAVQRIAAEVGTPDGPTICSLARATRQDIKAAAEALAPAAKGRIHTFIATSDIHLEYKLKKTRAEVLAVIPEMVGYAASLVDDVEFSPEDAGRSDPEFLYECLEAAIAAGAKTINIPDTVGYTTPSEFGALIGGIKQNVCNIDQAIISVHGHNDLGLAVANFLEAVKNGARQLECTINGIGERAGNAALEELVMALHVRRQYFNPFLGRAADSEAPLTQVNTREIYKTSRLVSNLTGMLVQPNKAIVGANAFAHESGIHQDGVLKNKLTYEIVDAETIGLSTNRITLGKLSGRNAFRTRLQELGYDLGEDDLNRAFLRFKELADKKREVTDRDLEAIVNDETQQAPELFKLELVQVSAGDHARPTATVTLRTPEGEELTDAAIGTGPVDAIYRAINRVVNIPNELIEFSVKSVTAGIDAIGEVTIRLRHEDRIFSGHSANTDILVASAQAYIHALNRLAEALQKDKPLHPQEPIVAGMGR

SEQ ID NO: 190 - protein, 202 aa, Synechococcus elongatus PCC7942
MGSEILEVTGRAVPLVGNDIDTDRIIPARFLRSVTFDGLGANVFIDDRQQLQGQHPFDQAQYQGATVLVVNRNFGCGSSREHAPQAIAKWGIQAIVGESFAEIFFGNCLSLGIPCVTAGAAAVAELQAAIASDPSQPVTVDLEELQVRRGAWSAELTLAPGPLQMLRSGQWDATGQLVANAEAIAQTAANLPYVGWQAIAAS

SEQ ID NO: 191 - protein, 468 aa, Synechococcus elongatus PCC7942
MSRGTLFDKVWDLHTVATLPSGQTQLFIGLHLIHEVTSPQAFSMLRDRGLTVKFPGRTVATVDHIVPTENQARPFADSLAEEMIVTLERNCRENGIRFYNIGSGSQGIVHVIAPEQGLTQPGMTIACGDSHTSTHGAFGAIAFGIGTSQVRDVLASQTLALSKLKVRKIEVNGELQPGVYAKDVILHIIRKLGVKGGVGYAYEFAGSTFAAMSMEERMTVCNMAIEGGARCGYVNPDQITYDYLQGREFAPQGEAWDRAIAWWESLRSEADAEYDDVVVFDAAEIAPTVTWGITPGQGIGITETIPTPDSLLDEDRAVAAEAYSYMDLEPGAPLQGTKVDVCFIGSCTNGRLSDLREAAKVAQGRKVAAGIKAFVVPGSERVKQQAEAEGLDQIFTAAGFEWRQAGCSMCLAMNPDKLEGRQISASSSNRNFKGRQGSASGRTLLMSPAMVAAAAIAGEVTDVRNWLN

SEQ ID NO: 192 - protein, 365 aa, Synechococcus elongatus PCC7942
MTRSYRITLLPGDGIGPEIMAVTVDILRAIGRQFDLNFEFEEALIGGSAIDATGEPLPEATLATCRNSDAVLLAAIGGYKWDSLPRSQRPETGLLGLRAGLGLFANLRPAAILPQLVDASSLKREVIEGVDLMVVRELTGGIYFGEPKGCFADEQGRQRAFNTMVYREDEIDRIGRVAFDIARKRGKRLCSVDKANVLEVSQLWRDRMTLLGSDYADVELSHLYVDNAAMQLVRWPKQFDTIVTGNLFGDILSDIAAMLTGSIGMLPSASLGAEGPGVFEPVHGSAPDIAGQDKANPLAQVLSAAMMLRYGLDEPEAAARIEAAVNQVLDQGYRTGDLYSEGMTLVGCKGMGDALLAALESPVSA

SEQ ID NO: 193 - protein, 570 aa, Bacillus subtilis subtilis 168
MTKATKEQKSLVKNRGAELVVDCLVEQGVTHVFGIPGAKIDAVFDALQDKGPEIIVARHEQNAAFMAQAVGRLTGKPGVVLVTSGPGASNLATGLLTANTEGDPVVALAGNVIRADRLKRTHQSLDNAALFQPITKYSVEVQDVKNIPEAVTNAFRIASAGQAGAAFVSFPQDVVNEVTNTKNVRAVAAPKLGPAADDAISAAIAKIQTAKLPVVLVGMKGGRPEAIKAVRKLLKKVQLPFVETYQAAGTLSRDLEDQYFGRIGLFRNQPGDLLLEQADVVLTIGYDPIEYDPKFWNINGDRTIIHLDEIIADIDHAYQPDLELIGDIPSTINHIEHDAVKVEFAEREQKILSDLKQYMHEGEQVPADWKSDRAHPLEIVKELRNAVDDHVTVTCDIGSHAIWMSRYFRSYEPLTLMISNGMQTLGVALPWAIGASLVKPGEKVVSVSGDGGFLFSAMELETAVRLKAPIVHIVWNDSTYDMVAFQQLKKYNRTSAVDFGNIDIVKYAESFGATGLRVESPDQLADVLRQGMNAEGPVIIDVPVDYSDNINLASDKLPKEFGELMKTKAL

SEQ ID NO: 194 - protein, 491 aa, Escherichia coli K-12, MG1655
MANYFNTLNLRQQLAQLGKCRFMGRDEFADGASYLQGKKVVIVGCGAQGLNQGLNMRDSGLDISYALRKEAIAEKRASWRKATENGFKVGTYEELIPQADLVINLTPDKQHSDVVRTVQPLMKDGAALGYSHGFNIVEVGEQIRKDITVVMVAPKCPGTEVREEYKRGFGVPTLIAVHPENDPKGEGMAIAKAWAAATGGHRAGVLESSFVAEVKSDLMGEQTILCGMLQAGSLLCFDKLVEEGTDPAYAEKLIQFGWETITEALKQGGITLMMDRLSNPAKLRAYALSEQLKEIMAPLFQKHMDDIISGEFSSGMMADWANDDKKLLTWREETGKTAFETAPQYEGKIGEQEYFDKGVLMIAMVKAGVELAFETMVDSGIIEESAYYESLHELPLIANTIARKRLYEMNVVISDTAEYGNYLFSYACVPLLKPFMAELQPGDLGKAIPEGAVDNGQLRDVNEAIRSHAIEQVGKKLRGYMTDMKRIAVAG

SEQ ID NO: 195 - protein, 616 aa, Escherichia coli K-12, MG1655
MPKYRSATTTHGRNMAGARALWRATGMTDADFGKPIIAVVNSFTQFVPGHVHLRDLGKLVAEQIEAAGGVAKEFNTIAVDDGIAMGHGGMLYSLPSRELIADSVEYMVNAHCADAMVCISNCDKITPGMLMASLRLNIPVIFVSGGPMEAGKTKLSDQIIKLDLVDAMIQGADPKVSDSQSDQVERSACPTCGSCSGMFTANSMNCLTEALGLSQPGNGSLLATHADRKQLFLNAGKRIVELTKRYYEQNDESALPRNIASKAAFENAMTLDIAMGGSTNTVLHLLAAAQEAEIDFTMSDIDKLSRKVPQLCKVAPSTQKYHMEDVHRAGGVIGILGELDRAGLLNRDVKNVLGLTLPQTLEQYDVMLTQDDAVKNMFRAGPAGIRTTQAFSQDCRWDTLDDDRANGCIRSLEHAYSKDGGLAVLYGNFAENGCIVKTAGVDDSILKFTGPAKVYESQDDAVEAILGGKVVAGDVVVIRYEGPKGGPGMQEMLYPTSFLKSMGLGKACALITDGRFSGGTSGLSIGHVSPEAASGGSIGLIEDGDLIAIDIPNRGIQLQVSDAELAARREAQDARGDKAWTPKNRERQVSFALRAYASLATSADKGAVRDKSKLGG

SEQ ID NO: 196 - DNA, 627 bp, Escherichia coli
atgatgaacttcaacaatgttttccgctggcatttgcccttcctgttcctggtcctgttaaccttccgtgccgccgcagcggacacgttattgattctgggtgatagcctgagcgccgggtatcgaatgtctgccagcgcggcctggcctgccttgttgaatgataagtggcagagtaaaacgtcggtagttaatgccagcatcagcggcgacacctcgcaacaaggactggcgcgccttccggctctgctgaaacagcatcagccgcgttgggtgctggttgaactgggcggcaatgacggtttgcgtggttttcagccacagcaaaccgagcaaacgctgcgccagattttgcaggatgtcaaagccgccaacgctgaaccattgttaatgcaaatacgtctgcctgcaaactatggtcgccgttataatgaagcctttagcgccatttaccccaaactcgccaaagagtttgatgttccgctgctgcccttttttatggaagaggtctacctcaagccacaatggatgcaggatgacggtattcatcccaaccgcgacgcccagccgtttattgccgactggatggcgaagcagttgcagcctttagtaaatcatgactcataa

SEQ ID NO: 197 - DNA, 1474 bp, Cuphea hookeriana
ctggataccattttccctgcgaaaaaacatggtggctgctgcagcaagttccgcattcttccctgttccagccccgggagcctcccctaaacccgggaagttcggaaattggccctcgagcttgagcccttccttcaagcccaagtcaatccccaatggcggatttcaggttaaggcaaatgacagcgcccatccaaaggctaacggttctgcagttagtctaaagtctggcagcctcaacactcaggaggacacttcgtcgtcccctcctcctcggactttccttcaccagttgcctgattggagtaggcttctgactgcaatcacgaccgtgttcgtgaaatctaagaggcctgacatgcatgatcggaaatccaagaggcctgacatgctggtggactcgtttgggttggagagtactgttcaggatgggctcgtgttccgacagagtttttcgattaggtcttatgaaataggcactgatcgaacggcctctatagagacacttatgaaccacttgcaggaaacatctctcaatcattgtaagagtaccggtattctccttgacggcttcggtcgtactcttgagatgtgtaaaagggacctcatttgggtggtaataaaaatgcagatcaaggtgaatcgctatccagcttggggcgatactgtcgagatcaatacccggttctcccggttggggaaaatcggtatgggtcgcgattggctaataagtgattgcaacacaggagaaattcttgtaagagctacgagcgcgtatgccatgatgaatcaaaagacgagaagactctcaaaacttccatacgaggttcaccaggagatagtgcctctttttgtcgactctcctgtcattgaagacagtgatctgaaagtgcataagtttaaagtgaagactggtgattccattcaaaagggtctaactccggggtggaatgacttggatgtcaatcagcacgtaagcaacgtgaagtacattgggtggattctcgagagtatgccaacagaagttttggagacccaggagctatgctctctcgcccttgaatataggcgggaatgcggaagggacagtgtgctggagtccgtgaccgctatggatccctcaaaagttggagtccgttctcagtaccagcaccttctgcggcttgaggatgggactgctatcgtgaacggtgcaactgagtggcggccgaagaatgcaggagctaacggggcgatatcaacgggaaagacttcaaatggaaactcggtctcttagaagtgtctcggaacccttccgagatgtgcatttcttttctccttttcattttgtggtgagctgaaagaagagcatgtcgttgcaatcagtaaattgtgtagttcgtttttcgctttgcttcgctcctttgtataataatatggtcagtcgtctttgtatcatttcatgttttcagtttatttacgccatataattttt

SEQ ID NO: 198 - protein, 5 aa, Artificial Sequence
  Pah1-encoded PAP1 enzyme catalytic motif
  VARIANT (2)..(2): Xaa = Any Amino Acid
  VARIANT (4)..(4): Xaa = Any Amino Acid
DXDXT

SEQ ID NO: 199 - protein, 1406 aa, Synechococcus elongatus PCC7942-0858
MSTTQRPESTPASINNQTTEALTPKLNGADQVTSFTSVETSSLSGPANKPARTGLKLKLTLLAIAMGVLPVLGVGVTVHNLVNRSITEMTETSSSPTAQVEADQLKRSLFLTLLWGTGLSAVAVGIIAAALANRSSRRLQAAIAALEKLSQGDVNVAVAEDGDDEIAVLGQEINHAASQIQTALATAEVSREQQRSETVRVNQLVREITLRLISQANVTDVLNVAVQEARAAIGCDRVVVYKFDETWAGTIIAESVDPGWPQALQVTIDDPCFRKDWVAAYAAGRVQVTADIYDANLTECHIKQLEPIAVRANLVTPIIVERRLIGLFIAHQCSGPYQWKQLEVDLMTQLATQVGLAMTRALFLEQQVIEAERAKLVRTITTELVAQADVEGVLRTAVQETRRALEADRVIVYEFDEKWSGKIIAESGDPNWPSGLNVVIDDPCFRRDWVEAYAAGRVQATADIYNAGLTECHIQQLEPLAVKANLVAPIVVEKKLIALFIAHQCSGPRDWQQSEIDLFAQIATQVGLAMTRARFLEQQIAEANRAKLVRSITSELVAQADVKSVLRTAVQETRRAIKADRVVVYEFDENWSGKIVAESSDSNWPAALNVVIDDPCFRRDWVEAYAAGRVQATADIYNAGLTECHIQQLEPLAVKANLVAPIVVEKKLIALFIAHQCSGPRNWQQSEIDLFSQLATQVGLATTRARFLEQQVSEVNRAKLVRDITSQLVSPTNVASVLQLAVHATRRALDTDRVVVYEFDSTWAGTVTAESVNPSWPSALNVTIDDPCFRRDWVDAYAAGRIQATPDIYNAGLTECHLKQLEPLAVKANLVAPIVVEKKLIALFVAHQCSGPRNWQRSEIDLFSQLATQLGLAITRARFLEQQVTEAKRAEQIREITSRLVAQANPEDVLQTAVKETRRALATDRVVVYAFDETWSGTVIAESVEYGWPSALSITIDDPCFRRDWVDAYAAGRIQATPDIYNAGFTECHLKQLEPLAVKANLVAPIVVEKKLIALFVAHQCSGARDWQQSEIDLFSQLATQIGLALARADFLQQAETARDRAEQLAQEQQQRTEAIQAELIQLLSDVEDASRGDLTVRADISAGEISTVADIFNSLIESLRAVVVQVKASTQKVNTSLDSDANSMQRLAADSQSQAEKIKKTLNAVAEMSKSILDVSNTANQAAEVARKSSQTAISSGQTMDETVRSILHLRETVAETAKKVKRLGESSQQISKVISLINQIALQTNLLAINASIEAARAGEEGRGFAVVAEEVGQLATRSANATKEIEQIVETIQQETNEVVTAMETGTSQVVEGTQLVEATKKSLEEIVQVSQQIDQLVQAISQATVSQSQTSNVVTNLMEEMAGFSEEISDTSRHISASLQATVAVAQKLKSSVDTFRVGAEE

SEQ ID NO: 200 - DNA, 4221 bp, Synechococcus elongatus PCC7942-0858
atgtccaccacccaacgccctgaaagcacccccgcttccatcaacaatcaaacgactgaagcgctgaccccaaaactaaacggtgctgatcaggtgacgtcattcacttcggttgaaacgagttctctctctggcccagctaacaaaccagcgcgcacgggactcaagctcaagttgaccctgctagcgattgctatgggtgtcctgcctgtcctaggggtaggagtcaccgttcataacctcgtcaaccggtcaattaccgagatgaccgaaacaagcagcagtccaacagcgcaggtggaagccgaccagctcaaacgcagtcttttcctgactctgctctggggtaccggcttatcagccgtggcggtcggcataattgcagctgctttggccaaccgcagtagccgacgcttgcaagctgcgatcgcagctcttgaaaagctcagtcaaggggatgtgaatgttgccgttgccgaggatggtgacgatgagattgccgttttagggcaagaaattaaccacgctgccagtcaaattcaaacagccttagcaactgcagaggtcagtcgggagcaacaacgctcagaaacagttcgggtcaatcagctggtccgtgaaattacgctgcggctgatttctcaagccaatgtgactgacgttctgaatgtcgcagtccaagaggctcgcgctgcgatcggatgtgatcgcgtggttgtctacaagtttgatgagacttgggctggaacgatcatcgctgagtcggttgatccaggatggccccaagctctgcaggtaaccattgatgatccttgtttccgcaaagattgggtagcggcctacgcagcgggtcgggttcaggtcacagctgatatttatgatgcgaatttaactgaatgccatatcaagcaactggagccgattgcagttcgtgccaacctagttaccccgatcattgttgagagacgactgattggtctattcattgctcaccaatgctctgggccgtaccagtggaagcagttagaagttgatctcatgactcagcttgccacacaagttggcttagctatgacgcgcgcgctgttcctagagcagcaggtgattgaagcagaacgcgctaagcttgtgcgaaccatcaccacagagctggtggctcaggctgatgttgagggggtgctgagaacagctgtccaagaaactcggagggctctcgaagccgaccgcgtcatcgtttatgaattcgatgagaagtggagcggcaaaattattgcggagtctggcgaccccaattggccatcaggactcaatgttgtcattgacgacccctgttttcgtcgggactgggttgaagcctatgcggctggacgcgttcaggcgacagcagatatttataatgcaggcctaaccgaatgtcatattcagcaactggagcccttggcggtcaaagccaatctggttgcgcccattgtggtcgagaaaaaactaatcgctctgtttattgcccaccaatgctcaggcccaagagactggcagcaatctgaaattgatctgttcgcccaaatagccacacaggtcggtttggcaatgacccgcgcgcgcttcttagaacagcaaattgctgaagccaatcgggccaaacttgtgcggtcaattacatcagagttagttgctcaagctgatgttaagagcgtgctcagaacagctgttcaagagactcgccgtgcaatcaaggccgatcgcgttgtggtctatgaatttgatgagaattggagtggcaagatcgttgctgagtcgagcgactctaattggccagcggccctcaacgttgtcattgatgacccctgcttccgtagagattgggttgaagcctacgcggctggacgcgttcaggcgacagcagatatttataatgcaggcctaaccgaatgtcatattcagcaactggagcccttggcggtcaaagccaatctggttgcgcccattgtggttgagaaaaaactgattgccttattcatcgcgcatcaatgttccggcccacgcaattggcaacagtctgaaattgatctctttagtcagctcgcgacacaagttggtttggcaacgactcgggctcgtttccttgagcaacaagtgtcagaggtcaaccgtgccaaactagttcgagacatcacctcacagctcgtttctcctacaaacgttgcaagtgtcttgcaactagcggtacacgcgactcgtcgtgcactcgatactgatcgcgttgttgtctacgaatttgacagtacttgggctggtacagtaaccgctgagtcggttaacccttcttggccttctgccctcaatgtcacgattgatgacccttgcttccgacgcgattgggtggatgcctatgctgcaggtcgaattcaagcgactccagacatctacaatgcaggcctcacagaatgccatctcaaacaactggagcccttggcagtcaaagccaatctggttgccccaattgtggttgagaaaaaactaattgctttgtttgttgctcatcaatgttcagggccacgtaactggcagcgatctgagattgatctgtttagtcagctagcaacgcaactagggttggcaattacccgcgcccgtttccttgagcaacaggttacagaggcaaaacgggcagagcaaatccgcgaaattacctccagattagttgcgcaagctaatcctgaagatgtgcttcaaactgcagtgaaagagactcgccgtgcgctcgctaccgatcgcgttgtggtctatgccttcgatgaaacttggtcaggtactgtgattgcagagtcagttgaatatggctggccctcagcactgagtatcacgatcgatgacccctgcttcagacgggattgggtagatgcctatgctgcaggccgcattcaggcgactcctgatatttacaatgctggatttacggaatgccatctcaagcaattggagcctttggcagtcaaggccaatctggtggccccgattgtggttgagaaaaaactgattgccctgtttgttgctcaccaatgttcaggagcacgagattggcagcaatctgaaattgatttgtttagccaactcgccacgcaaattggcttagccttagcgcgtgcagattttctacagcaagctgaaacagcacgcgatcgcgctgagcaactggcacaagagcaacagcaacggaccgaagcgattcaagccgaactgattcaacttctcagtgatgtcgaagatgcatcacgaggtgatctcactgttcgtgctgacatctcagccggtgaaattagtacagttgctgatattttcaactctctgattgaaagtttgcgagccgtcgtagtccaagtaaaagcctccactcagaaggtgaatacttctctggatagcgatgctaactcgatgcaacgactagcagcagactcccaaagtcaggcagaaaagattaaaaagaccctaaatgctgttgctgagatgtcgaaatcaattcttgatgtctcgaacacagcaaaccaagctgctgaagttgcacgcaaatcatcgcaaacagctatcagtagtggtcaaacaatggatgagactgttcgcagtattcttcatctacgcgaaactgttgctgaaactgctaagaaggtgaagcggctcggtgaatcttctcaacagatctcaaaagtgatctcgttgattaaccaaattgctctgcaaacaaatctacttgcaattaatgccagtattgaggcggcacgagctggtgaagaaggtcgtggctttgcagtcgttgcagaagaggttggccagttagcaacacggtccgctaacgctaccaaggaaattgagcagattgttgaaacgattcagcaagaaacgaatgaggtggttacggctatggaaacaggtaccagccaagtagtcgagggaacacagctggtcgaggcgactaagaaaagccttgaagaaatcgtgcaggtttcccaacagattgaccaacttgtacaggcaatctcgcaagcaaccgtcagccagtctcagacctctaatgttgtgactaacctcatggaggagatggccggtttctcagaggaaatttcagacacctcccgtcacatttccgcttcactacaggctactgtggctgtcgctcagaaacttaaatcctccgttgacacctttagagtcggagctgaggaatag

SEQ ID NO: 201 - protein, 839 aa, Synechococcus elongatus PCC7942-1015
MTSMASEDRSLSYEQVEQEYLSGHYSEAAELAEALVQTEPQNPRLRLLRGHIFYSLGRNDQARVEYELIRGITPDPDILEQALLGMDRCDSRPHEDVSSDMEGTVIVPIGAALPVIEQVDPSALALDLPPLSGTDTIAEEPSSDRDDGDNPFATDPASPAASETEAEAPAWLADIEESAFSSTDESSPEPWAEAAEAEETAVAEPAVEEAIAPAAETLIASEPEAIPEPLSPEVDLAESQPPITADETVVEVDLAAEFAALAEPEEVASEPAASTAGLEEPGPVSFDAIADEVAKEVLGAAETAVAPQPELKASPAPVLENLPTPPNLAEAAAIARQPVTSPLRPQETKANRAAVAATPASNAPKALPTPPKQTAETRVGLIALVSALAAAAVGVVGWQASTPEARNRVVLASMASMAVAGAASAGIALQLQNRTGKRYRDLLERLNEQCQQMSNGDFETPLQVGGNDDVGMLALRFDRMRSVLGDRINRQEKRLTTLEQQREGLQNQVIRLLDDVEGVAHGDLTVQAEVTADVLGAVADSFNLTIQNLREIVAQVRDAALQVNAAATDNEQSAKNLSAEALHQAEELAAALNSVQVMTESIQRVAISASEAESVARAASQTALKGGEAVDKTLSGILRIRETVAETTRKVKKLAESSQEISKIVALISQVASRTNLLALNASIEAARAGQAGRGFAIVADEVRQLADRAAKSSKEIEQIVLKIQSETGLVMTAMEEGTQQVIQGTRLAEQARGALDEIIQVSTKIDDLVQSITADTVQQTAMSRSMAEVMQSVETTAQNTSQEAQQVAASLQGLVNIAGTLRESVDRFRLQASAAKEN

SEQ ID NO: 202 - DNA, 2520 bp, Synechococcus elongatus PCC7942-1015
atgacttcgatggcatctgaagaccgcagcctctcctacgagcaagttgaacaggagtacctcagtggccactacagtgaagcagctgagctagctgaggcactggttcagactgagccgcagaatcctcgcctgcgcttgctgcgcggtcatatcttctacagcttggggcgcaatgaccaagcacgggtcgagtacgagctgatccggggaatcacgcccgatcccgacattctcgagcaggctctgctgggaatggaccgttgtgatagccgcccccacgaggacgttagttcggatatggaaggcacggtgattgtgccgattggggcagctttgccggtgatcgaacaagtggatccgtcggccctagcactcgatttgcccccgctgagtggtacggatacgatcgcagaggaacctagctccgatcgcgatgatggcgacaatccttttgccaccgatccggctagccctgccgcctctgagaccgaggctgaggcaccagcctggttagcggacatagaagaatcagcattttcgtccacggatgaatcgagtcccgaaccttgggcagaggctgcggaagctgaagagacagcggtagcggagccagcagtagaggaagcgatcgccccagcggcagaaacgctgatcgccagtgagcctgaggcgattccagagccgctgtcgccagaagtcgatcttgctgaatcgcagccgccgatcacagcggacgagactgtcgtagaagttgatctggccgcagagttcgccgccttggctgagccagaagaggttgccagtgagccagccgcttctactgctgggctggaggaaccggggccggtcagttttgacgcgatcgctgatgaagtggccaaagaggtgctcggtgcagcagaaactgccgttgcgcctcagcccgagctgaaagccagtcctgcccccgttctcgagaacctacccacgccgcccaacctcgctgaagctgccgcgatcgctcggcaaccagtgacgtccccgctgcgcccccaagagaccaaagccaatcgggcagctgttgcggccactcctgccagcaatgcacccaaagccttaccaaccccgcccaagcaaacagcagaaacccgtgttggcttaatcgccctggtctcagccctagctgctgctgccgtaggggtggttggctggcaagcttcaacacccgaagcccgcaaccgcgttgtgctcgccagcatggccagcatggctgtggctggggctgcctctgctggtattgctctgcagctgcagaaccggacgggcaagcgctaccgcgatctgctggagcgacttaatgaacagtgccagcagatgagtaatggcgactttgaaacgcctctccaagtcggtggcaacgatgatgtcgggatgttggccctgcgcttcgatcgtatgcgcagtgtcttgggcgatcgcatcaaccgccaagagaagcgcctgaccaccctagagcagcaacgggaaggcctccaaaaccaggtgattcgtctgctggacgacgtagagggggtagcccacggtgacttgaccgttcaggctgaggtgacggccgacgttctcggggccgtggcggactcgttcaacctgacgattcagaacctacgcgagatcgtggcccaggtgcgcgatgcagcactgcaggtcaacgcagccgcaaccgacaacgaacagtccgcgaaaaacctgtcagcggaagcgctccaccaagccgaggaactcgccgctgccctcaactcagtccaggtgatgacggagtcgattcaacgggttgccatcagtgccagcgaagcggagtcggtcgcccgcgctgcttcgcaaacagctctcaagggcggtgaggcggttgacaagaccctctcagggattttgcggattcgcgaaacggtggccgaaacaacccgcaaggtgaagaagctggccgagtcttcccaagaaatttccaagatcgtggcgctgatctcgcaggtcgcttcacgaaccaacctgttggcactcaacgccagcattgaggcagctcgggccggtcaagccggacgagggtttgcgatcgttgcggatgaggttcgccagctggccgatcgcgccgcgaagtcctcgaaggagattgagcagatcgtgctcaagattcagagtgagacaggtttggtaatgactgccatggaggagggtacccagcaggtgattcaagggacgcgactggcagaacaggcccgtggtgctcttgatgaaatcattcaggtttcgaccaaaattgacgaccttgtccaatcgattacggccgacactgtgcaacagaccgccatgtctcgcagcatggccgaggtgatgcagtcggtggagaccaccgctcaaaacacctctcaagaggcgcagcaagtggctgcttccctgcagggcttggtaaatattgcagggacgttgcgagagtctgtggaccgcttccgcctacaagcatcggctgctaaggagaactga

SEQ ID NO: 203 - protein, 4 aa, Artificial Sequence
  Gly / Ser containing linker
GSGS

SEQ ID NO: 204 - protein, 4 aa, Artificial Sequence
  Gly / Ser containing linker
GGSG

SEQ ID NO: 205 - protein, 4 aa, Artificial Sequence
  Gly / Ser containing linker
GGGS

SEQ ID NO: 206 - protein, 5 aa, Artificial Sequence
  Gly / Ser containing linker
GGGGS

SEQ ID NO: 207 - protein, 4 aa, Artificial Sequence
  Gly / Asn containing linker
GNGN

SEQ ID NO: 208 - protein, 4 aa, Artificial Sequence
  Gly / Asn containing linker
GGNG

SEQ ID NO: 209 - protein, 4 aa, Artificial Sequence
  Gly / Asn containing linker
GGGN

SEQ ID NO: 210 - protein, 5 aa, Artificial Sequence
  Gly / Asn containing linker
GGGGN

SEQ ID NO: 211 - DNA, 1665 bp, Mycobacterium bovis
gtgaacccctcgacgacacaggcgcgcgtcgtcgtcgacgaactgatccgcggcggcgttcgcgacgtggtgctgtgtccgggctcgcgcaatgcgccgctggccttcgcgctgcaggacgccgaccggtccggccggatccggttgcacgttcgcatcgatgaacgcaccgccggctacctggccatcgggctggcaatcggggcgggcgcgccggtgtgtgtcgcgatgacatccggcaccgccgtggccaacctcggtccggcggtggtggaggcaaactacgctcgggtgccgctgatcgtgctgtcagccaatcggccctacgagctgctgggcaccggcgccaaccagaccatggaacagctgggctatttcggcacccaggtgcgcgccagcatcagcctggggctggccgaggacgcacccgagcggacctcggcgctcaacgcgacctggcgatcggctacgtgccgagtgttggcggccgccacgggtgctcgcaccgccaacgcgggccccgtgcacttcgacatcccgctgcgcgaaccgctggtgcccgatcccgagcccctcggcgcggtcaccccgccgggccggcctgctggcaagccgtggacctacacgccgccggtcaccttcgaccagccactggacatcgacctgtcggtcgacaccgtggtcatctccgggcatggcgctggcgtgcaccccaacctcgcggcgttgccgaccgtcgcagaaccgacggcgccgcggtccggggacaacccgttgcacccgctggcgctgccgctgctgcgccctcaacaggtgatcatgctgggccggccgacactgcatcgtccggtatcggtgctgctggccgacgcagaagtgccggtattcgcattgacaaccggtccacgctggccggatgtctcgggtaactcgcaggccaccggcacgcgggcggtcaccaccggcgcgccgcggcccgcgtggctggaccggtgtgcggcgatgaaccggcacgcgatcgcggcggttcgggaacagctcgcggcgcacccgttgaccaccgggctgcatgtcgcggcggcggtgtcgcatgcgctgcggcccggtgaccagctggtgctcggggcatccaatccggtgcgggatgtggcgttggccggtttggacacccgcggcatccgggtacggtccaaccgtggggtcgccggcatcgacggcaccgtgtccaccgcgatcggggcggccctagcttatgagggggctcacgagcgcaccggcagcccggactccccgccccgcaccatcgcactgatcggcgacctgacgttcgtgcacgacagctccgggctgttgatcgggccgaccgaaccgataccgcggtcattgaccatcgtggtgtctaatgacaacggcggcggcatcttcgaattgctcgagcagggtgatcccaggttctccgacgtgtcatcgcgaatcttcggcaccccacacgacgtcgatgtgggcgcattgtgccgcgcctaccacgtggaatctcgccagatcgaggtcgacgaactcggaccgaccctcgatcaacccggtgccggcatgcgcgtgctcgaggtcaaggccgaccggtcgtcgttgcgacaattgcacgccgccatcaaggcggctctgtga

SEQ ID NO: 212 - DNA, 1638 bp, Synechococcus sp PCC 7002
gtgaatactgcagaattattgatccgatgtctagaaaatgaaggggtggagtatatttttgggctgccgggggaagaaaatctccatatcctcgaagcccttaaggagtctcccatccgctttatcaccgtccgccatgaacagggtgccgcttttatggccgatgtgtatggtcgtttaaccgggaaagcaggggtttgtctgtctaccctggggcctggggctaccaatctaatgactggggttgccgatgcgaacctcgatggggcgcccctgattgcgattacagggcaggtgggtaccgaccgcatgcacattgaatcccaccaatatcttgatctggtggcgatgtttgcccccgtcaccaagtggaataaacaaattgtccgaccgaacacgaccccggaggtggtacgtcgtgcctttaaaattgcccagcaggaaaaaccaggggcagtacacatcgatctccctgaaaatattgcggcgatgcccgtagaaggtcagcccctccagcgggatggtcgtgaaaaaatctatgcttcaagccggagtttaaaccgggctgccgaggcgatcgcccatgccaagagtcctttaattctggtgggtaatggcattattcgcgccgatgccgccgaagccctcaccgattttgccacccagttgaatattcccgtagtcaacacctttatgggcaaaggggcaattccctacacccatcccctgtccctgtggacggtaggactccaacagcgggattttgtcacctgtgcctttgaacagagcgatttggtgattgcagtgggctacgatctgatcgaatattcccccaaacgctggaacccagagggaacgaccccaattatccacattggtgaagtggccgccgaaattgatagtagttatattcccctcacagaagttgtcggcgacattggcgatgccttaaatgaaattcgtaaacgcacagaccgtgagggcaaaaccgcgccaaaatttctcaatgtccgggctgagattcgggaggactatgaacgccacggcaccgacgctagttttccggtcaaaccccaaaaaatcatctacgatctccgccaagtgatggccccagaggacatcgtcatttctgatgtgggggcccacaaaatgtggatggcccgccattaccattgcgatcgccccaatacttgcctgatttccaatggatttgcggcgatgggcattgcgattcccggtgctgtagcagccaaattagtctacccagaaaaaaatgtcgtggctgtcacaggggacgggggatttatgatgaactgccaggagctcgaaacggccctgcgcattggggcgaactttgtcaccctaattttcaatgatggtggctatggtttgatcggttggaaacagattaaccagttcggtgcaccagcctttgtggagtttggcaatcccgattttgtgcagtttgccgaaagtatgggcctcaagggttatcggattaccgccgccgccgaccttgtgccgaccttaaaagaagccctagcccaggatgtaccagcggtgatcgattgccccgtggactacagtgagaatgtgaaattctcccaaaaatcaggggatttaatctgccgtatgtaa

SEQ ID NO: 213 - DNA, 1116 bp, Porphyromonas gingivalis
atgcaacttttcaaactcaagagtgtaacacatcactttgacacttttgcagaatttgccaaggaattctgtcttggagaacgcgacttggtaattaccaacgagttcatctatgaaccgtatatgaaggcatgccagctcccctgccattttgttatgcaggagaaatatgggcaaggcgagccttctgacgaaatgatgaataacatcttggcagacatccgtaatatccagttcgaccgcgtaatcggtatcggaggaggtacggttattgacatctctaaacttttcgttctgaaaggattaaatgatgtactcgatgcattcgaccgcaaaatacctcttatcaaagagaaagaactgatcattgtgcccacaacatgcggaacgggtagcgaggtgacgaacatttctatcgcagaaatcaaaagccgtcacaccaaaatgggattggctgacgatgccattgttgcagaccatgccatcatcatacctgaacttctgaagagcttgcctttccacttctacgcatgcagtgcaatcgatgctcttatccatgccatcgagtcatacgtatctcctaaagccagtccatattctcgtctgttcagtgaggcggcttgggacattatcctggaagtattcaagaaaatcgccgaacacggccctgaataccgcttcgaaaagctgggagaaatgatcatggccagcaactatgccggtatagccttcggaaatgcaggagtaggagccgtccacgcactatcctacccgttgggaggcaactatcacgtgccgcatggagaagcaaactatcagttcttcacagaggtattcaaagtataccaaaagaagaatcctttcggctatatagtcgaactcaactggaagctctccaagatactgaactgccagcccgaatacgtatatccgaagctggatgaacttctcggatgccttcttaccaagaaacctttgcacgaatacggcatgaaggacgaagaggtaagaggctttgcggaatcagtgcttaagacacagcaaagattgctcgccaacaactacgtagagcttactgtagatgagatcgaaggtatctacagaagactctactaa

SEQ ID NO: 214 - DNA, 1116 bp, Clostridium kluyveri
atgaagttattaaaattggcacctgatgtttataaatttgatactgcagaggagtttatgaaatactttaaggttggaaaaggtgactttatacttactaatgaatttttatataaacctttccttgagaaattcaatgatggtgcagatgctgtatttcaggagaaatatggactcggtgaaccttctgatgaaatgataaacaatataattaaggatattggagataaacaatataatagaattattgctgtagggggaggatctgtaatagatatagccaaaatcctcagtcttaagtatactgatgattcattggatttgtttgagggaaaagtacctcttgtaaaaaacaaagaattaattatagttccaactacatgtggaacaggttcagaagttacaaatgtatcagttgcagaattaaagagaagacatactaaaaaaggaattgcttcagacgaattatatgcaacttatgcagtacttgtaccagaatttataaaaggacttccatataagttttttgtaaccagctccgtagatgccttaatacatgcaacagaagcttatgtatctccaaatgcaaatccttatactgatatgtttagtgtaaaagctatggagttaattttaaatggatacatgcaaatggtagagaaaggaaatgattacagagttgaaataattgaggattttgttataggcagcaattatgcaggtatagcttttggaaatgcaggagtgggagcggttcacgcactctcatatccaataggcggaaattatcatgtgcctcatggagaagcaaattatctgttttttacagaaatatttaaaacttattatgagaaaaatccaaatggcaagattaaagatgtaaataaactattagcaggcatactaaaatgtgatgaaagtgaagcttatgacagtttatcacaacttttagataaattattgtcaagaaaaccattaagagaatatggaatgaaagaggaagaaattgaaacttttgctgattcagtaatagaaggacagcagagactgttggtaaacaattatgaacctttttcaagagaagacatagtaaacacatataaaaagttatattaa

SEQ ID NO: 215 - DNA, 1290 bp, Clostridium kluyveri
atggagtgggaagagatatataaagagaaactggtaactgcagaaaaagctgtttcaaaaatagaaaaccatagcagggtagtttttgcacatgcagtaggagaacccgtagatttagtaaatgcactagttaaaaataaggataattatataggactagaaatagttcacatggtagctatgggcaaaggtgaatatacaaaagagggtatgcaaagacattttagacataatgctttatttgtaggcggatgtactagagatgcagtaaattcaggaagagcagattatacaccttgttttttctatgaagtgccaagtttgtttaaagaaaaacgtttgcctgtagatgtagcacttattcaggtaagtgagccagataaatatggctactgcagttttggagtttccaatgactataccaagccagcagcagaaagtgctaagcttgtaattgcagaagtgaataaaaacatgccaagaactcttggagattcttttatacatgtatcagatattgattatatagtggaagcttcacacccattgttagaattgcagcctcctaaattgggagatgtagaaaaagccataggagaaaactgtgcatctttaattgaagatggagctactcttcagcttggaataggtgctataccagatgcggtacttttattcttaaagaacaaaaagaatttaggaatacattctgagatgatatcagatggtgtgatggaactggtgaaggcaggggttatcaataacaagaaaaagaccctccatccaggcaaaatagttgtaacatttttaatgggaacaaaaaaattatatgattttgtaaacaataatccaatggtagaaacttattctgtagattatgtaaataatccactggtaattatgaaaaatgacaatatggtttcaataaattcttgtgttcaagtagacttaatgggacaagtatgttctgaaagtataggattgaaacagataagtggagtgggaggccaggtagattttattagaggagctaatctatcaaagggtggaaaggctattatagctataccttccacagctggaaaaggaaaagtttcaagaataactccacttctagatactggtgctgcagttacaacttctagaaatgaagtagattatgtagttactgaatatggtgttgctcatcttaagggcaaaactttaagaaatagggcaagagctctaataaatatcgctcatccaaaattcagagaatcattaatgaatgaatttaaaaagagattttag

SEQ ID NO: 216 - DNA, 2577 bp, Clostridium acetobutylicum
atgaaagttacaaatcaaaaagaactaaaacaaaagctaaatgaattgagagaagcgcaaaagaagtttgcaacctatactcaagagcaagttgataaaatttttaaacaatgtgccatagccgcagctaaagaaagaataaacttagctaaattagcagtagaagaaacaggaataggtcttgtagaagataaaattataaaaaatcattttgcagcagaatatatatacaataaatataaaaatgaaaaaacttgtggcataatagaccatgacgattctttaggcataacaaaggttgctgaaccaattggaattgttgcagccatagttcctactactaatccaacttccacagcaattttcaaatcattaatttctttaaaaacaagaaacgcaatattcttttcaccacatccacgtgcaaaaaaatctacaattgctgcagcaaaattaattttagatgcagctgttaaagcaggagcacctaaaaatataataggctggatagatgagccatcaatagaactttctcaagatttgatgagtgaagctgatataatattagcaacaggaggtccttcaatggttaaagcggcctattcatctggaaaacctgcaattggtgttggagcaggaaatacaccagcaataatagatgagagtgcagatatagatatggcagtaagctccataattttatcaaagacttatgacaatggagtaatatgcgcttctgaacaatcaatattagttatgaattcaatatacgaaaaagttaaagaggaatttgtaaaacgaggatcatatatactcaatcaaaatgaaatagctaaaataaaagaaactatgtttaaaaatggagctattaatgctgacatagttggaaaatctgcttatataattgctaaaatggcaggaattgaagttcctcaaactacaaagatacttataggcgaagtacaatctgttgaaaaaagcgagctgttctcacatgaaaaactatcaccagtacttgcaatgtataaagttaaggattttgatgaagctctaaaaaaggcacaaaggctaatagaattaggtggaagtggacacacgtcatctttatatatagattcacaaaacaataaggataaagttaaagaatttggattagcaatgaaaacttcaaggacatttattaacatgccttcttcacagggagcaagcggagatttatacaattttgcgatagcaccatcatttactcttggatgcggcacttggggaggaaactctgtatcgcaaaatgtagagcctaaacatttattaaatattaaaagtgttgctgaaagaagggaaaatatgctttggtttaaagtgccacaaaaaatatattttaaatatggatgtcttagatttgcattaaaagaattaaaagatatgaataagaaaagagcctttatagtaacagataaagatctttttaaacttggatatgttaataaaataacaaaggtactagatgagatagatattaaatacagtatatttacagatattaaatctgatccaactattgattcagtaaaaaaaggtgctaaagaaatgcttaactttgaacctgatactataatctctattggtggtggatcgccaatggatgcagcaaaggttatgcacttgttatatgaatatccagaagcagaaattgaaaatctagctataaactttatggatataagaaagagaatatgcaatttccctaaattaggtacaaaggcgatttcagtagctattcctacaactgctggtaccggttcagaggcaacaccttttgcagttataactaatgatgaaacaggaatgaaataccctttaacttcttatgaattgaccccaaacatggcaataatagatactgaattaatgttaaatatgcctagaaaattaacagcagcaactggaatagatgcattagttcatgctatagaagcatatgtttcggttatggctacggattatactgatgaattagccttaagagcaataaaaatgatatttaaatatttgcctagagcctataaaaatgggactaacgacattgaagcaagagaaaaaatggcacatgcctctaatattgcggggatggcatttgcaaatgctttcttaggtgtatgccattcaatggctcataaacttggggcaatgcatcacgttccacatggaattgcttgtgctgtattaatagaagaagttattaaatataacgctacagactgtccaacaaagcaaacagcattccctcaatataaatctcctaatgctaagagaaaatatgctgaaattgcagagtatttgaatttaaagggtactagcgataccgaaaaggtaacagccttaatagaagctatttcaaagttaaagatagatttgagtattccacaaaatataagtgccgctggaataaataaaaaagatttttataatacgctagataaaatgtcagagcttgcttttgatgaccaatgtacaacagctaatcctaggtatccacttataagtgaacttaaggatatctatataaaatcattttaa

SEQ ID NO: 217 - DNA, 2676 bp, Escherichia coli
atggctgttactaatgtcgctgaacttaacgcactcgtagagcgtgtaaaaaaagcccagcgtgaatatgccagtttcactcaagagcaagtagacaaaatcttccgcgccgccgctctggctgctgcagatgctcgaatcccactcgcgaaaatggccgttgccgaatccggcatgggtatcgtcgaagataaagtgatcaaaaaccactttgcttctgaatatatctacaacgcctataaagatgaaaaaacctgtggtgttctgtctgaagacgacacttttggtaccatcactatcgctgaaccaatcggtattatttgcggtatcgttccgaccactaacccgacttcaactgctatcttcaaatcgctgatcagtctgaagacccgtaacgccattatcttctccccgcacccgcgtgcaaaagatgccaccaacaaagcggctgatatcgttctgcaggctgctatcgctgccggtgctccgaaagatctgatcggctggatcgatcaaccttctgttgaactgtctaacgcactgatgcaccacccagacatcaacctgatcctcgcgactggtggtccgggcatggttaaagccgcatacagctccggtaaaccagctatcggtgtaggcgcgggcaacactccagttgttatcgatgaaactgctgatatcaaacgtgcagttgcatctgtactgatgtccaaaaccttcgacaacggcgtaatctgtgcttctgaacagtctgttgttgttgttgactctgtttatgacgctgtacgtgaacgttttgcaacccacggcggctatctgttgcagggtaaagagctgaaagctgttcaggatgttatcctgaaaaacggtgcgctgaacgcggctatcgttggtcagccagcctataaaattgctgaactggcaggcttctctgtaccagaaaacaccaagattctgatcggtgaagtgaccgttgttgatgaaagcgaaccgttcgcacatgaaaaactgtccccgactctggcaatgtaccgcgctaaagatttcgaagacgcggtagaaaaagcagagaaactggttgctatgggcggtatcggtcatacctcttgcctgtacactgaccaggataaccaaccggctcgcgtttcttacttcggtcagaaaatgaaaacggcgcgtatcctgattaacaccccagcgtctcagggtggtatcggtgacctgtataacttcaaactcgcaccttccctgactctgggttgtggttcttggggtggtaactccatctctgaaaacgttggtccgaaacacctgatcaacaagaaaaccgttgctaagcgagctgaaaacatgttgtggcacaaacttccgaaatctatctacttccgccgtggctccctgccaatcgcgctggatgaagtgattactgatggccacaaacgtgcgctcatcgtgactgaccgcttcctgttcaacaatggttatgctgatcagatcacttccgtactgaaagcagcaggcgttgaaactgaagtcttcttcgaagtagaagcggacccgaccctgagcatcgttcgtaaaggtgcagaactggcaaactccttcaaaccagacgtgattatcgcgctgggtggtggttccccgatggacgccgcgaagatcatgtgggttatgtacgaacatccggaaactcacttcgaagagctggcgctgcgctttatggatatccgtaaacgtatctacaagttcccgaaaatgggcgtgaaagcgaaaatgatcgctgtcaccaccacttctggtacaggttctgaagtcactccgtttgcggttgtaactgacgacgctactggtcagaaatatccgctggcagactatgcgctgactccggatatggcgattgtcgacgccaacctggttatggacatgccgaagtccctgtgtgctttcggtggtctggacgcagtaactcacgccatggaagcttatgtttctgtactggcatctgagttctctgatggtcaggctctgcaggcactgaaactgctgaaagaatatctgccagcgtcctaccacgaagggtctaaaaatccggtagcgcgtgaacgtgttcacagtgcagcgactatcgcgggtatcgcgtttgcgaacgccttcctgggtgtatgtcactcaatggcgcacaaactgggttcccagttccatattccgcacggtctggcaaacgccctgctgatttgtaacgttattcgctacaatgcgaacgacaacccgaccaagcagactgcattcagccagtatgaccgtccgcaggctcgccgtcgttatgctgaaattgccgaccacttgggtctgagcgcaccgggcgaccgtactgctgctaagatcgagaaactgctggcatggctggaaacgctgaaagctgaactgggtattccgaaatctatccgtgaagctggcgttcaggaagcagacttcctggcgaacgtggataaactgtctgaagatgcattcgatgaccagtgcaccggcgctaacccgcgttacccgctgatctccgagctgaaacagattctgctggatacctactacggtcgtgattatgtagaaggtgaaactgcagcgaagaaagaagctgctccggctaaagctgagaaaaaagcgaaaaaatccgcttaa

SEQ ID NO: 218 - DNA, 1167 bp, Escherichia coli
atgaacttacatgaatatcaggcaaaacaactttttgcccgctatggcttaccagcaccggtgggttatgcctgtactactccgcgcgaagcagaagaagccgcttcaaaaatcggtgccggtccgtgggtagtgaaatgtcaggttcacgctggtggccgcggtaaagcgggcggtgtgaaagttgtaaacagcaaagaagacatccgtgcttttgcagaaaactggctgggcaagcgtctggtaacgtatcaaacagatgccaatggccaaccggttaaccagattctggttgaagcagcgaccgatatcgctaaagagctgtatctcggtgccgttgttgaccgtagttcccgtcgtgtggtctttatggcctccaccgaaggcggcgtggaaatcgaaaaagtggcggaagaaactccgcacctgatccataaagttgcgcttgatccgctgactggcccgatgccgtatcagggacgcgagctggcgttcaaactgggtctggaaggtaaactggttcagcagttcaccaaaatcttcatgggcctggcgaccattttcctggagcgcgacctggcgttgatcgaaatcaacccgctggtcatcaccaaacagggcgatctgatttgcctcgacggcaaactgggcgctgacggcaacgcactgttccgccagcctgatctgcgcgaaatgcgtgaccagtcgcaggaagatccgcgtgaagcacaggctgcacagtgggaactgaactacgttgcgctggacggtaacatcggttgtatggttaacggcgcaggtctggcgatgggtacgatggacatcgttaaactgcacggcggcgaaccggctaacttccttgacgttggcggcggcgcaaccaaagaacgtgtaaccgaagcgttcaaaatcatcctctctgacgacaaagtgaaagccgttctggttaacatcttcggcggtatcgttcgttgcgacctgatcgctgacggtatcatcggcgcggtagcagaagtgggtgttaacgtaccggtcgtggtacgtctggaaggtaacaacgccgaactcggcgcgaagaaactggctgacagcggcctgaatattattgcagcaaaaggtctgacggatgcagctcagcaggttgttgccgcagtggaggggaaataa

SEQ ID NO: 219 - DNA, 870 bp, Escherichia coli
atgtccattttaatcgataaaaacaccaaggttatctgccagggctttaccggtagccaggggactttccactcagaacaggccattgcatacggcactaaaatggttggcggcgtaaccccaggtaaaggcggcaccacccacctcggcctgccggtgttcaacaccgtgcgtgaagccgttgctgccactggcgctaccgcttctgttatctacgtaccagcaccgttctgcaaagactccattctggaagccatcgacgcaggcatcaaactgattatcaccatcactgaaggcatcccgacgctggatatgctgaccgtgaaagtgaagctggatgaagcaggcgttcgtatgatcggcccgaactgcccaggcgttatcactccgggtgaatgcaaaatcggtatccagcctggtcacattcacaaaccgggtaaagtgggtatcgtttcccgttccggtacactgacctatgaagcggttaaacagaccacggattacggtttcggtcagtcgacctgtgtcggtatcggcggtgacccgatcccgggctctaactttatcgacattctcgaaatgttcgaaaaagatccgcagaccgaagcgatcgtgatgatcggtgagatcggcggtagcgctgaagaagaagcagctgcgtacatcaaagagcacgttaccaagccagttgtgggttacatcgctggtgtgactgcgccgaaaggcaaacgtatgggccacgcgggtgccatcattgccggtgggaaagggactgcggatgagaaattcgctgctctggaagccgcaggcgtgaaaaccgttcgcagcctggcggatatcggtgaagcactgaaaactgttctgaaataa

SEQ ID NO: 220 - DNA, 1356 bp, Porphyromonas gingivalis
atggaaatcaaagaaatggtgagccttgcgcgcaaggctcagaaggagtatcaagctactcataaccaagaagcagttgacaacatttgccgagctgcagcgaaagttatttatgaaaatgcagctattctggctcgcgaagcagtagacgaaaccggcatgggcgtttacgaacacaaagtggccaagaatcaaggcaaatccaaaggtgtttggtacaacctccacaataaaaaatcggttggtatcctcaatatagacgagcgtaccggtatgatcgagatcgcaaagcctatcggagttgtaggagccgtaacgccgacgaccaacccgatcgttactccgatgagcaatatcatctttgctcttaagacttgcaatgccatcattattgccccccaccccagatctaaaaaatgctctgcacacgcagttcgtctgatcaaagaagctatcgctccgttcaacgtaccggaaggtatggttcagatcatcgaagaacccagcatcgagaagacgcaggaactcatgggcgccgtagacgtagtagttgctacgggaggtatgggcatggtgaagtctgcatattcttcaggaaagccttctttcggtgttggagccggtaacgttcaggtgatcgtggatagcaacatcgatttcgaagccgctgcagaaaaaatcatcaccggtcgtgctttcgacaacggtatcatctgctcaggcgaacagagcatcatctacaacgaggctgacaaggaagcagttttcacagcattccgcaaccacggtgcatatttctgtgacgaagccgaaggagatcgggctcgtgcggctatcttcgaaaatggagccatcgcgaaagatgtagtaggtcagagtgttgccttcattgccaagaaagcaaacatcaatatccccgagggtacccgtattctcgttgttgaagctcgcggcgtaggagcagaagacgttatctgtaaggaaaagatgtgtcccgtaatgtgcgccctcagctacaagcacttcgaagaaggtgtagaaatcgcacgtacgaacctcgccaacgaaggtaacggccacacctgtgctatccactccaacaatcaggcacacatcatcctcgcaggatcagagctgacggtatctcgtatcgtagtgaatgctccgagtgctactacagcaggcggtcacatccaaaacggtcttgccgtaaccaatacgctcggatgcggatcatggggtaataactctatctccgagaacttcacttacaagcacctcctcaacatttcacgcatcgcaccgctgaattcaagcattcacatccccaatgacaaagaaatctgggaactctaa

SEQ ID NO: 221 - DNA, 1944 bp, Synechococcus elongatus PCC7942
atggcggctgaacaaacggcgatcgcacccttggcggtagctgttgagtcgcagcagtggcgcattgaagacagcgaagcgctctatcggattcagggctggggtgagccttactttggtatcaatgctgccggtcacattaccgtttcaccccaaggcgatcgcggcggctccctcgacctttatgaactcgtagaagcgctgcggcggcggggcctgaatctgcccttgctgatccgctttcccgatattttggaagaccggatcgagcggttgaatgcttgctttgccaaagcgatcgctcgttataactatgccggtgagtatcggggcgttttccccgtcaagtgcaaccagcagcgccatttgatcgaaagtttggtcaactatgggcgtccttttcaatttgggctagaagcgggttcaaagccggaactattaattgccctggcgcacttggatacgccgggggcgttgctgatctgcaacggctataaagatcgggactatatcgaaacggcgattctgggacggcgcttgggcaaaacgcccatccttgtgattgagcaactggaagaagtggacgttgcgatcgccgccagccagcgcttggggatcgaacccattttaggtgtgcgtgccaagctcaacgccagaggaatggggcgctggggcagttcggcaggcgatcgcgccaagtttggtctgaccatgcccgagattgtggcggcagtcgagaaacttcaggcagcgaacctgctgcactgtctgcaactgctgcacttccatatcggctcgcaaatttctgatatcagcgtgctcaaggatgcgatccaagaagcagcgcagatctatgtgcaactggccgccttgggcgcagacatgcgttatctcgatgttggtggtggtttgggggtcgattacgacggttcgaagaccaacttccacgcctcgaaaaactacaacatgcagacctacgccaacgatgtggttgccacgattaaggatgcttgtcaggcacaccggctggctgtcccgaccttaacgagtgagagtgggcgcgcgatcgcctctcaccaatcggtgttggtatttgatgtgttgggcagtagcgaggtgcctcgggctgccgtggaaccacctcaggaagaggattctgcgatcgtccgcaccctttacgaagtcttggaagcgatcgcccttgagaatctgcaggagtgctatcacgatgccttcaaactcaaggaagatgcggtttctgccttccgcttgggctatttgagtttgacagagcgcgccaaagcagagcgactcttttggagctgctgccatcggattcaggagttcttgaagcaactcgaccgcattcctgaagatctcgaagatctagaacgggtgatggcgtcgatttattacgtcaacctctccgtcttccaatcagctcccgatacttgggcgatcgatcagctcttcccaatcatgccgattcatcgtctgaatgaagagcctaatcagcgggtaacgcttgcagatctgacctgtgatagcgatggcaaaattgatcgctttattgacttgctagatgtcaaatctacgttagaacttcattcgctccagcccgaccaaccctacgttttagggatgtttttaggcggtgcctaccaagagattatgggtaatcttcataacctgtttggggataccaatgccgtccatatcaaactgacgcctaagggctacagcattgagcatgtggttaaaggtgacacgatgggcgaagtcttgggctatgtccaatacgatacggaacagcttctagaacgtctacgccagcaaactgaagctgctttgcaacaggatcaaatcagtttagatgaagcccagcggctgcttcgccattatgaagagggtctacagcggtatacctatctcagcttggattag

SEQ ID NO: 222 - DNA, 1131 bp, Synechococcus elongatus PCC7942
atgaggggggatttcgcaccgaacgaccgtacccaaacaaccgaagccgctaggctgaacaagggtctttttgctagtcaaatcatgagtcaggggcaacagagcgatcgccgttttccagcggaatgggaagcgcaggacggtgttttgattgcttggccccatgcggacagtgattggcgatcgctgttggatcaggtcgatcgcgtctaccgtgacctagcggaagcagtgacgcgctttgagcagttgctgatcgtgacgccagagcccgatcgcgtggcagaacaactggcgcagaccactgcgaattgcgatcgcattcagattgttgaactgcccaccaatgacacttggagccgcgattttgggccgctgacggtggaaaccccagcagggctgcgactgctggattggggcttcaatggctggggcctaaagtttgccgccaaccacgacaaccaagtgacacggcgactttggcagcaaggaatttttggcaccacgccgctggaaactgtgccgctgatttttgaagggggcagtatcgaaagtgatggacgcggcaccctactcaccacgagtcagtgtttgctggaagcgaatcgtaatccgggcttgagccgcgaggcgatcgcgcagatcatccagcgacaactggggggcgatcgcctgctctggttggagcatggccatttggaaggcgatgacacggacgcccacatcgacacgctggtgcggatcgcacctaatgacacgctgatttacgttgcctgcgacgatcccagtgacagtcatgcggcagaactaacagcccttgaagcagaactcaaagccttgcgcgcggcggacggacagccctaccacttgattcccttgccttggccgcaaccctgcttcgatgcggatggtcagcgcttgccgacaacctacgccaattacttagtcatcaatggcgcagtcttagtaccgacttacaacgatccggcagatgaggcggcgatcgcggcaatcgccgctgctttccccgatcgcctcgcgatcggcatcaactgtcggccactcctggagcaacatggctcactgcattgcatcacgatgcaactgcctgctggacttctcagtcgctaa

SEQ ID NO: 223 - DNA, 888 bp, Synechococcus elongatus PCC7942
atggcttcgacgttgcgtgtcgctctggctcaactggcatttagcgatcagccggtgatcgatcgcgatcgcgtgacagcagcgattcgggaagctgcagcagctggggcagaactgattgtgctgcccgagatccacggcggctactacttttgccagaccgaagatccagctcagtttgatcgcgccgagtccattccaggaccgagtacggactactacagcgcgatcgcccgagaactgtccgttgttctcatcctttcgctgtttgagcggcgggcagccggactctaccacaacactgctgtcgtgattgaacgggatggaacgatcgcgggtcgttaccgcaaaatgcacattcctgacgatccggcttactacgagaagttctacttcacgccgggcgacttggggtttgaaccgattcagacttcggtgggcaagttaggggttctggtctgctgggatcagtggtatcccgaagcagcgcgactgatggcgctggctggtgccgagttgctgatctatccgaccgcaatcggctgggatccgcaagacgtgcccgaggaacaacagcggcaactcgaagcttggcaaaccgtgcagcggggtcacgcaatcgccaatggaattcccgtgttgagtgtcaatcgggttggctttgaaccctcgcccgatccagctgctgcgggcagtcaattctggggcagcagtttcattgccgggccgcagggggaatggttagcaaaggctggcgatcgcgagccggaactgctgattgctgatctcgatcgcgatcgcagtgaacaggtgcggcggatctggcccttcctgcgcgatcgccgcatcgatgcctacggcgatttagtacgtcgctatcgagactaa

SEQ ID NO: 224 - protein, 661 aa, Marinobacter aquaeolei VT8   YP_959769.1
MNYFLTGGTGFIGRFLVEKLLARGGTVYVLVREQSQDKLERLRERWGADDKQVKAVIGDLTSKNLGIDAKTLKSLKGNIDHVFHLAAVYDMGADEEAQAATNIEGTRAAVQAAEAMGAKHFHHVSSIAAAGLFKGIFREDMFEEAEKLDHPYLRTKHESEKVVREECKVPFRIYRPGMVIGHSETGEMDKVDGPYYFFKMIQKIRHALPQWVPTIGIEGGRLNIVPVDFVVDALDHIAHLEGEDGNCFHLVDSDPYKVGEILNIFCEAGHAPRMGMRIDSRMFGFIPPFIRQSIKNLPPVKRITGALLDDMGIPPSVMSFINYPTRFDTRELERVLKGTDIEVPRLPSYAPVIWDYWERNLDPDLFKDRTLKGTVEGKVCVVTGATSGIGLATAEKLAEAGAILVIGARTKETLDEVAASLEAKGGNVHAYQCDFSDMDDCDRFVKTVLDNHGHVDVLVNNAGRSIRRSLALSFDRFHDFERTMQLNYFGSVRLIMGFAPAMLERRRGHVVNISSIGVLTNAPRFSAYVSSKSALDAFSRCAAAEWSDRNVTFTTINMPLVKTPMIAPTKIYDSVPTLTPDEAAQMVADAIVYRPKRIATRLGVFAQVLHALAPKMGEIIMNTGYRMFPDSPAAAGSKSGEKPKVSTEQVAFAAIMRGIYW

SEQ ID NO: 225 - DNA, 1986 bp, Marinobacter aquaeolei VT8   YP_959769.1
atgaattatttcctgacaggcggcaccggttttatcggtcgttttctggttgagaaactcttggcgcgcggcggcaccgtgtatgttctggttcgcgagcagtcccaggacaagctggagcggctccgggagcgctggggtgcagacgacaagcaagtgaaggctgtgatcggcgacctcaccagcaaaaaccttggtattgacgcgaaaacgctgaaatcactgaaaggaaatatcgaccacgtattccatcttgccgcggtctacgacatgggcgcagacgaagaagcccaggccgccaccaatatcgaaggcaccagggcggctgttcaggccgccgaagccatgggcgccaagcatttccatcatgtgtcatccatcgcggcagcgggtctgttcaagggtatcttccgggaggatatgttcgaagaagccgagaagcttgatcatccttacctgcgcaccaagcacgaatccgaaaaagttgtgcgtgaagaatgcaaggttccgttccgcatctaccgccctggtatggtcattggccattcggaaaccggcgaaatggacaaggttgacgggccctattacttcttcaagatgattcagaagatccgtcatgcgttgccccagtgggtccccaccatcggtattgaaggtggccggctgaacattgtgccggtggatttcgtggtcgatgcactggatcacattgcccatctggaaggcgaagatggcaactgtttccatctggtggactccgatccgtataaggtgggtgagatcctcaatattttctgcgaggccggccatgccccccgcatgggtatgcgcatcgattcccggatgttcggttttattccgccgtttattcgccagagcatcaagaatctgcctccggtcaagcgcattactggtgcgcttctggatgacatgggcattccgccctcggtgatgtccttcattaattacccgacccgttttgatacccgggagctggagcgggttctgaagggcacagacattgaggtgccgcgtctgccgtcctatgccccggttatctgggactactgggagcgcaatctggacccggacctgttcaaggaccgcaccctcaagggcacggttgaaggtaaggtttgcgtggtcaccggcgcgacctcgggtattggcctggcaacggcagagaagctggcagaggccggtgccattctggtcattggtgcgcgcaccaaggaaactctggatgaagtggcggccagtctggaggccaagggtggcaacgtgcatgcgtaccagtgcgacttttcggacatggacgactgcgaccgctttgtgaagacggtgctggataatcacggccacgtggatgtactggtgaataacgcgggtcgctccatccgccgctcgctggcgttgtcttttgaccggttccacgattttgagcggaccatgcagctgaactactttggctccgttcggctgatcatgggctttgcgccagccatgctggagcgtcgccgcgggcacgtggtgaatatttcttccatcggggtacttaccaacgctccgcgtttctcggcctatgtctcctcgaaatccgcactggacgcgttcagccgctgtgccgctgcagaatggtcggatcgcaacgtgaccttcaccaccatcaacatgccgttggtgaaaacgccgatgatcgcgcccaccaaaatctacgattccgtgccgacgctgacgccggatgaagccgcccagatggtggcggatgcgattgtgtaccggcccaagcgcattgccacccgtcttggcgtgttcgcgcaggttctgcatgcgctggcaccgaagatgggtgagatcattatgaacactggctaccggatgttcccggattctccagcagccgctggcagcaagtccggcgaaaagccgaaagtctctaccgagcaggtggcctttgcggcgattatgcgggggatatactggtaa

SEQ ID NO: 226 - protein, 493 aa, Simmondsia chinensis (Jojoba)  AF149917
MEEMGSILEFLDNKAILVTGATGSLAKIFVEKVLRSQPNVKKLYLLLRATDDETAALRLQNEVFGKELFKVLKQNLGANFYSFVSEKVTVVPGDITGEDLCLKDVNLKEEMWREIDVVVNLAATINFIERYDVSLLINTYGAKYVLDFAKKCNKLKIFVHVSTAYVSGEKNGLILEKPYYMGESLNGRLGLDINVEKKLVEAKINELQAAGATEKSIKSTMKDMGIERARHWGWPNVYVFTKALGEMLLMQYKGDIPLTIIRPTIITSTFKEPFPGWVEGVRTIDNVPVYYGKGRLRCMLCGPSTIIDLIPADMVVNATIVAMVAHANQRYVEPVTYHVGSSAANPMKLSALPEMAHRYFTKNPWINPDRNPVHVGRAMVFSSFSTFHLYLTLNFLLPLKVLEIANTIFCQWFKGKYMDLKRKTRLLLRLVDIYKPYLFFQGIFDDMNTEKLRIAAKESIVEADMFYFDPRAINWEDYFLKTHFPGVVEHVLN

SEQ ID NO: 227 - DNA, 1482 bp, Simmondsia chinensis (Jojoba)  AF149917
atggaggaaatgggaagcattttagagtttcttgataacaaagccattttggtcactggtgctactggctccttagcaaaaatttttgtggagaaggtactgaggagtcaaccgaatgtgaagaaactctatcttcttttgagagcaaccgatgacgagacagctgctctacgcttgcaaaatgaggtttttggaaaagagttgttcaaagttctgaaacaaaatttaggtgcaaatttctattcctttgtatcagaaaaagtgactgtagtacccggtgatattactggtgaagacttgtgtctcaaagacgtcaatttgaaggaagaaatgtggagggaaatcgatgttgttgtcaatctagctgctacaatcaacttcattgaaaggtacgacgtgtctctgcttatcaacacgtatggagccaagtatgttttggacttcgcgaagaagtgcaacaaattaaagatatttgttcatgtatctactgcttatgtatctggagagaaaaatgggttaatactggagaagccttattatatgggcgagtcacttaatggaagattaggtctggacattaatgtagagaagaaacttgtggaggcaaaaatcaatgaacttcaagcagcgggggcaacggaaaagtccattaaatcgacaatgaaggacatgggcatcgagagggcaagacactggggatggccaaatgtgtatgtattcaccaaggcattaggggagatgcttttgatgcaatacaaaggggacattccgcttactattattcgtcccaccatcatcaccagcacttttaaagagccctttcctggttgggttgaaggtgtcaggaccatcgataatgtacctgtatattatggtaaagggagattgaggtgtatgctttgcggacccagcacaataattgacctgataccggcagatatggtcgtgaatgcaacgatagtagccatggtggcgcacgcaaaccaaagatacgtagagccggtgacataccatgtgggatcttcagcggcgaatccaatgaaactgagtgcattaccagagatggcacaccgttacttcaccaagaatccatggatcaacccggatcgcaacccagtacatgtgggtcgggctatggtcttctcctccttctccaccttccacctttatctcacccttaatttcctccttcctttgaaggtactggagatagcaaatacaatattctgccaatggttcaagggtaagtacatggatcttaaaaggaagacgaggttgttgttgcgtttagtagacatttataaaccctacctcttcttccaaggcatctttgatgacatgaacactgagaagttgcggattgctgcaaaagaaagcatagttgaagctgatatgttttactttgatcccagggcaattaactgggaagattacttcttgaaaactcatttcccaggtgtcgtagagcacgttcttaactaa

SEQ ID NO: 228 - protein, 514 aa, Euglena gracilis  GU733919
MNDFYAGKGVFLTGVTGFVGKMVVEKILRSLPTVGRLYVLVRPKAGTDPHQRLHSEVWSSAGFDVVREKVGGPAAFDALIREKVVPVPGDMVKDRFGLDDAAYRSLAANVNVIIHMAATIDFTERLDVAVSLNVLGTVRVLTLARRARELGALHSVVHVSTCYVNSNQPPGARLREQLYPLPFDPREMCTRILDMSPREIDLFGPQLLKQYGFPNTYTFTKCMAEQLGAQIAHDLPFAIFRPAIIGAALSEPFPGWCDSASACGAVFLAVGLGVLQELQGNASSVCDLIPVDHVVNMLLVTAAYTASAPPADPSPSSLALSPPQLPLATLPPGTVADVPIYHCGTSAGPNAVNWGRIKVSLVEYWNAHPIAKTKAAIALLPVWRFELSFLLKRRLPATALSLVASLPGASAAVRRQAEQTERLVGKMRKLVDTFQSFVFWAWYFQTESSARLLASLCPEDRETFNWDPRRIGWRAWVENYCYGLVRYVLKQPIGDRPPVAAEELASNRFLRAML

SEQ ID NO: 229 - DNA, 1545 bp, Euglena gracilis  GU733919
atgaacgatttctacgcggggaagggcgtgtttttaacgggggtgaccgggttcgtgggcaagatggtggtggagaagatcctgcggtcgctgcccactgtgggccggctctatgtgctggtccgccctaaggccgggacggacccccaccagcggctgcacagcgaggtgtggtcctcggcgggcttcgacgtggtccgggaaaaggtcggagggccggcagcatttgacgccctcatccgcgaaaaggtggttcccgtgccaggggacatggtaaaggaccggttcggtctggacgacgccgcctaccgctccctggctgcgaacgtgaacgtcatcatccacatggccgccaccatcgacttcaccgagcggctggacgtggcggttagcctcaacgtgctgggcacggtgcgcgtcttgacgctggcgaggcgggcgcgggagctaggggcgctgcacagcgtcgtgcacgtcagcacgtgctacgtcaactccaaccagccccccggcgcccgcctccgcgagcagctgtacccgctgccgttcgacccgcgggagatgtgcacgcgcatcctggacatgagcccacgggagatcgacctcttcgggccacagctcctgaagcagtacggcttccccaacacgtacaccttcacaaagtgcatggcggagcagctgggggcgcagatcgcccacgacttgccgttcgccatcttccggccggccatcatcggggcggccctgtcggagccgttccccggctggtgcgactccgccagcgcgtgcggcgccgtgttcctcgccgtcggcctcggggtgcttcaggaattgcagggcaacgcctcttccgtctgtgacctgatcccggtggatcacgtggtcaacatgctgctggtgaccgccgcctacaccgcctcggcccctcccgctgacccctccccttcctccctggccctatctccgccgcagctgccattggcaacactgccacctggcaccgtggcggacgtccccatctaccactgcggcaccagcgccggcccgaacgccgtgaactggggccgcatcaaggtgtcccttgtcgagtactggaacgcccaccccatcgccaagacgaaggccgccatcgccctcctgccggtgtggcggttcgagctctccttcctgctgaagcgccggctgcccgccacggcgctgtcgctggttgcctcattgcccggggccagtgccgcggtgcggcgccaggcggagcagacggagcggctggtgggcaagatgcgcaagctggtggacacattccagagcttcgtgttctgggcgtggtacttccagaccgagagctccgcgcgcctgctggcctccctctgccccgaggaccgggagacgttcaactgggacccacgacgcatcgggtggcgggcatgggtggagaactactgctacgggctggtgcggtacgtgctgaagcagcccatcggggaccggccgcccgtcgccgccgaggagctggcctccaaccgattcctgcgggccatgctgtga

SEQ ID NO: 230 - protein, 505 aa, Hahella chejuensis YP_436183
MKQSLTLTAFANKNVLITGTTGFVGKVVLEKLLRSVPTIGKIYLLIRGNSKNPTARKRFQNEIATSSIFDTLKASQGSRFEELCETRIHCVTGEVTEPLFGLSEKDFTDLAADIDVIINSAASVNFREALDQALTINTLCLKNIIELSRRAADCPVVQVSTCYVNGFNQGVMEEEIVSPAGERIERSERGYYEVEPLIARLLQDVEQVSAAAADDHSREKDLIDLGIKEANKYGWNDTYTFTKWMGEQLLMKELYGKTLTILRPSIVESTLLGPAPGWIEGVKVADAIILAYAREKVSLFPGKKNAVIDIIPADLVANSIILSATEALLDSGAHRIYQCCSSEVNPIRIREVIGHVQQEAEHNYQTHDKLFYRKPKKPFVMIPGAVFHALMAISFHMLKWSSRLQSLFGRKASGRKLSNMETTMKLSKVFSFYTSPSYTFSNRRLQELSTRLGEYDQSEFPVNAGMYDWAHYLREVHVAGLNKYALRPKVVKMNPPAAKPRSRAA

SEQ ID NO: 231 - DNA, 1518 bp, Hahella chejuensis YP_436183
atgaagcaatcacttacgttaactgcttttgctaataagaatgtactgattacggggacgacgggattcgtcggcaaggtggtactggagaagctgctgcgcagcgtgccgacaattgggaagatttatttgctgatacggggtaattcaaagaaccctacagcgcgaaagcggttccagaatgagatcgcgacctcatctattttcgatactctcaaggcatcgcagggaagtcgtttcgaggagttgtgcgaaacccgcatccactgcgtgaccggagaggtgacggagcctctgtttggcctgtcggagaaggactttaccgacctggccgcagatatcgacgttattatcaattcagccgccagcgtcaatttccgcgaagcgctggatcaggctctcaccatcaataccctgtgccttaaaaatatcattgaactgtcgcggcgcgcggcggactgccctgtcgtgcaggtatccacctgctacgtcaacggcttcaatcagggagtgatggaagaggaaatcgtcagcccggcgggagaacgcattgagcgttcagaacgcggctactatgaagttgagccgctgattgcgcgtttgctgcaggatgtagagcaagtgtccgccgctgcggcggatgatcatagcagggaaaaggatcttatcgacctgggtatcaaagaagccaataagtatggttggaacgatacctataccttcactaaatggatgggcgagcagttgctgatgaaggagctgtatggcaaaaccctgaccatcctgcgaccttccattgttgaaagtacgctgctgggaccggcgccgggctggattgagggggtgaaagtggcggatgcgatcatcctcgcttacgccagagaaaaggtgtctttgtttcccggcaagaagaatgcggtcattgatatcattccggcggacctggtggccaacagcatcatcctgagcgccacggaagcgctgctggattccggcgcccatcgcatctaccagtgttgcagcagcgaggttaatccaatcaggattcgggaagtcattgggcatgtgcagcaagaggcggagcacaattatcagacgcacgacaaactgttctaccgcaagccgaagaagccctttgtaatgattcccggcgccgtgtttcacgcgttgatggcgatcagtttccacatgctgaaatggagttcccgtctgcagagcttgtttggccgtaaggcttccgggcgcaagctgagcaacatggaaactacgatgaaactgtccaaggtgttttccttctatacctctcccagctataccttcagcaaccgccgtctgcaggagctatccacccgtcttggggaatatgaccagagcgagttccccgtgaatgcgggtatgtatgactgggcgcactacttgcgggaagttcacgtggcgggtctgaacaagtacgcgctgcggccgaaagtggtgaagatgaacccgcctgcagcaaaacctcgcagccgcgctgcgtaa

SEQ ID NO: 232 - protein, 663 aa, Photobacterium profundum SS9 YP_130411.1
MAYFLTGGTGFLGRNLITRLLKREGTIYVLCHNEQSQDILEAHIEKWSIPAGRILPITGDLTQAGLGLAKEDIKKLSGSITHFFHLAAIYDLNATAEIQEAVNIEGTQNAVDAAENLQAGCFHHISSIAAAGLYEGHFREDMFDEAENLDHPYFSTKHLSEKVVREKCKVPFRVYRPGMVVGDSKTGIADRADGPYYFFKMIQRIRNVLPAWVPTIGLEGGRLNIVPVDYVVDALDYIAHKDGLDNRCFHLTDPKPYRSGEVLNIFAEAGHAPRMALRLDARLFGFIPNQMKNAILSLPTIKQISDVTMKDLGIPSSALQFFTYPTEFDCRETQKALKGSGIECPRLPSYAPAIWDYWERHLDPEISGDRSLKGRVENKIILITGASSGIGQATAFKLAENGAQMILVARDEEKLANTRMEVEERGGIAHTYQCDLSKIEQVDTLVENILADHGRVDILINNAGRSIRRSVANSVDRFHDFERTMQLNYFGALKLTLGLLPSMEAQGGGHVINISSIGVLTNAPRFSAYVASKAAMDAFTRCAASEYSDMNINFTTINMPLVATPMIAPTKIYKSVPTLSPDQAADLLATAIIDKPKRIATKLGIFGSVLHALFPKLAEIIMNSSFRMFPDSKESEQSKEDKTEKASSAELMAFSALLRGIHL

SEQ ID NO: 233 - DNA, 1992 bp, Photobacterium profundum SS9 YP_130411.1
atggcatattttttgactggcggaacaggttttcttggccgaaacctcatcaccagacttttaaaacgagaaggcacgatttacgtcctttgtcataatgaacaatcacaagatatactcgaagctcacatagagaaatggtctattccagcgggtcgtatcttacctatcacaggggatttaacgcaggctggtttaggtttagccaaagaagatattaaaaaattatctggctctattacgcattttttccaccttgcggctatttatgatttaaatgccacagccgaaatacaagaagccgtcaacatcgaagggacacaaaatgctgtcgatgcggctgaaaatttacaagcaggttgcttccatcacatcagctcaattgcagcagctggcttgtacgaagggcacttccgcgaagatatgttcgatgaagcagaaaatctagatcacccttacttctcaaccaaacacttatcagagaaagtggttcgtgaaaaatgtaaagtcccttttcgtgtgtaccgtccgggtatggttgtgggcgattcaaaaacggggattgcagatcgtgccgatgggccgtactacttcttcaaaatgatacaacgcattcgtaatgtattgcctgcatgggtcccaactattggtttagaaggcggacgtcttaatatcgtaccagttgattacgttgttgatgcactagactatattgcgcataaagatggcttagataatcgttgttttcacctaacagatcctaaaccttaccgttcaggtgaagtgcttaatatttttgctgaagcgggccatgcgcctcgtatggcattacgtttagatgcacgcttatttggctttattcccaatcaaatgaagaacgctattttatcgttaccaacgattaaacaaattagcgacgtaacgatgaaagaccttggtattccttcatcagcattacaattcttcacctaccctacagaatttgattgccgtgaaacgcaaaaagccctaaaaggctctggcattgagtgccctcgcttaccaagctatgcccctgcaatttgggattattgggagcgtcaccttgacccagaaatctcgggtgatcgcagccttaaaggtcgcgtagaaaataagatcattttgatcactggtgcaagctcaggcattgggcaagcaacagcgttcaaacttgccgagaatggcgcacaaatgattttggttgctcgtgatgaagagaaactagctaatactagaatggaagtagaagaacgtggtggtatcgcgcatacataccagtgcgatttatccaaaatagaacaggtagatacgcttgttgagaatatcttggccgatcatggccgtgttgatatcttaatcaataacgcaggtcgatcgattcgtcgctctgttgccaattccgttgatcgttttcatgactttgaacgcacaatgcagcttaactactttggcgcattgaaactaaccttaggcttactaccaagtatggaagcacaaggtggcggccatgttattaatatttcatccattggcgtactcactaacgcccctcgtttctctgcttatgttgcttcaaaagcagcgatggatgcatttacacgctgtgcagcctctgaatattcagacatgaacattaacttcacaacgatcaacatgcctttagtggcaacaccaatgatcgcgccaacgaagatttacaaatctgtaccaacattatcgccagatcaagctgctgatttattagcaacggcaatcattgataagccaaagcgtattgcgactaagttaggtattttcggttccgttcttcatgcccttttccctaaacttgctgaaataatcatgaacagtagcttccgcatgttccctgattcgaaagaaagtgagcaaagtaaagaggataaaacagaaaaagcatcatcagcagagctaatggcattctctgcactactacgtggtattcacttgtag

SEQ ID NO: 234 - protein, 512 aa, Marinobacter algicola DG893 ZP_01892457
MATQQQQNGASASGVLEQLRGKHVLITGTTGFLGKVVLEKLIRTVPDIGGIHLLIRGNKRHPAARERFLNEIASSSVFERLRHDDNEAFETFLEERVHCITGEVTESRFGLTPERFRALAGQVDAFINSAASVNFREELDKALKINTLCLENVAALAELNSAMAVIQVSTCYVNGKNSGQITESVIKPAGESIPRSTDGYYEIEELVHLLQDKISDVKARYSGKVLEKKLVDLGIREANNYGWSDTYTFTKWLGEQLLMKALSGRSLTIVRPSIIESALEEPSPGWIEGVKVADAIILAYAREKVSLFPGKRSGIIDVIPVDLVANSIILSLAEALSGSGQRRIYQCCSGGSNPISLGKFIDYLMAEAKTNYAAYDQLFYRRPTKPFVAVNRKLFDVVVGGMRVPLSIAGKAMRLAGQNRELKVLKNLDTTRSLATIFGFYTAPDYIFRNDSLMALASRMGELDRVLFPVDARQIDWQLYLCKIHLGGLNRYALKERKLYSLRAADTRKKAA

SEQ ID NO: 235 - DNA, 1539 bp, Marinobacter algicola DG893 ZP_01892457
atggcaacacagcagcaacaaaacggagcgtcagcgtccggtgttcttgagcaactacgtggtaaacacgtgctgatcaccggcaccaccgggtttcttggtaaggtggtactggaaaaattgattcgcacggtgccggatattggcgggatccatcttcttatccgtggtaacaaaaggcatcctgcagcacgggaacgattcctcaacgagatcgccagttcttccgtgttcgaacgccttcggcacgatgacaacgaggcgtttgaaacctttcttgaggaacgcgttcactgcatcaccggcgaagtgacagagtcgcgtttcgggctcacgccggagcggttccgtgcacttgccgggcaggtcgatgcgtttataaattccgcagccagtgtgaacttccgggaggaactcgacaaggcgctgaagattaacaccctgtgcctggagaacgttgccgctctggcggagctcaatagcgccatggcggttatccaggtgtccacctgctacgtcaatggcaagaactccggccagatcacggagtccgtcatcaagccggcgggcgagtctattccccgcagcaccgacggctactatgaaatcgaagagcttgtgcatttgctgcaggacaaaatttccgacgtgaaagcccgatactccggcaaagtacttgaaaaaaagctggtggacctggggattcgagaggccaacaactacggctggagtgacacctacacgtttaccaaatggctgggtgagcaactcctgatgaaagccctttccgggcgttcacttacgattgttcgcccttccatcattgaaagtgcactggaagagccttcgccaggatggattgaaggtgtgaaggtggcagacgccattatccttgcctatgcccgtgagaaggtctccctgttcccaggcaagcgtagcggcattatcgatgtgatcccggtggacctggtggccaacagtatcatcttgtccctggcagaagccctttccgggtcagggcagcgccgcatctatcaatgctgcagtggcggttctaatccgatttcgctgggcaagttcattgactacctgatggccgaagccaagaccaactatgcagcgtatgaccagttgttctaccgacggcccacgaaaccgtttgtggcggtcaatcgcaagctgtttgatgttgtggttggcggcatgcgcgtgccgttgtcgattgctggcaaggcaatgaggctggctggccagaaccgtgagctcaaggttctcaaaaacctcgataccacgcgttcactggccaccatctttggtttctacacggcaccggattacatcttccgtaacgattcgctgatggccctggcttcgcgcatgggtgaactggaccgtgtcctgttcccggtggatgcgcgtcagattgactggcagctgtacttgtgcaagatccacctgggaggtctcaaccgctacgctctgaaggagcgaaaactgtacagcctgcgggccgccgacacccgcaaaaaagccgcctga

SEQ ID NO: 236 - protein, 511 aa, Marinobacter adhaerens HP15  ADP96574
MATQQLNPDASSKVLERLRGKHVLITGTTGFLGKVVLEKLIRAVPDIGGIHLLIRGNKRHPDARDRFFEEIATSSVFDRLRQDDNEAFETFIEDRVHCVTGEVTEPLFGLSADRFRKLAGGIDVVVNSAASVNFREELDKALAINTRCLDNVAELARQNKSLAVLQVSTCYVNGMNSGQITETVIKPAGEAIPRSTEGYYEIEELVRLLEDKIADVRSRYSGKALEKKLVDLGIREANHYGWSDTYTFTKWLGEQLLLKALSGRALTIVRPSIIESALEEPAPGWIEGVKVADAIILAYAREKVTLFPGKRAGVIDVIPVDLVANAIILAAAEAVADSPRHRIYQCCSGSSNPVSLGQFIDHLMAESKANFAEYDQLFYRQPTKPFIAVNRRLFDAVVGGVRIPLSITGKVLRMLGQNRELKVLRNLDTTRSLATIFGFYTAPDYIFRNDDLLALASRMGELDKVLFPVDARQIDWSVYLRKIHLAGLNRYALKERKVYSLRSAKARKKAA

SEQ ID NO: 237 - DNA, 1536 bp, Marinobacter adhaerens HP15  ADP96574
atggcaacacagcagctgaatcccgatgcatcatcaaaagtacttgagcggctccggggcaagcacgttctgattaccggcaccacgggctttctcggcaaggtggttctggaaaagctcattcgcgccgttccggacataggcggcattcatctgctgatccgtggaaacaaacgtcaccccgatgcgcgggatcgtttttttgaggagatcgccacgtcgtcagtcttcgatcgtctgcgccaggacgataacgaggcttttgaaaccttcattgaagatcgtgtgcattgcgtaaccggggaagtgaccgagcctttgtttggtctgtccgctgaccgtttccgcaagctggctggcggcatcgatgtggttgtcaactccgcagccagtgtgaacttccgggaagagcttgataaagcgcttgccatcaatacccgttgcctcgacaacgtggccgagcttgcgcgacagaacaagtcgctggcggtgctgcaggtttccacctgctatgtaaacggcatgaactccggacagatcacggagaccgtgatcaagccggcaggtgaggccataccccggagcactgaaggttactatgagatcgaagaacttgtccggctgctggaggacaagatagcggacgtgcgttcccgctactccggcaaggcactggaaaagaagctggtggaccttggcatccgtgaagccaaccattatggctggagcgatacctatacctttaccaaatggctcggtgagcaactcctgctcaaggccctgtccgggcgggcactgaccattgtgcgcccatccattattgaaagtgcactggaggaacccgcgccaggctggattgaaggtgtgaaggtggcggatgccattatccttgcgtatgcccgcgagaaggtcacgctcttccctggcaaacgcgctggcgtcatcgatgttattcccgtggatctggtggccaatgccatcatcctggcggcggctgaagccgttgctgattcgccacgtcaccggatttaccagtgttgcagtggcagctccaacccggtttctctcgggcagtttattgaccacctcatggcggaatccaaagccaacttcgccgaatacgatcagctgttctaccgacagccgaccaaacccttcattgcagtcaaccgccggctgttcgatgccgtcgtaggcggggtgcgcattccactgagcattaccgggaaggttttgcgcatgctgggccaaaatcgcgagttgaaagtgctccggaatctggacacgacacgctcgctggcgaccattttcggtttctacaccgcgccagactatatcttccggaatgatgatctgctggccctggcatcgaggatgggtgagctggacaaggtgctgttcccggtagatgcccgccagattgactggtcggtctatctgcgcaagatccacctggcaggcctgaaccgatacgccctcaaggagcgcaaggtatacagcctgcgctctgccaaggcccgaaaaaaggcagcgtga

SEQ ID NO: 238 - protein, 493 aa, Arabidopsis thaliana, CER4 NM_119537
MSTEMEVVSVLKYLDNKSILVVGAAGFLANIFVEKILRVAPNVKKLYLLLRASKGKSATQRFNDEILKKDLFKVLKEKYGPNLNQLTSEKITIVDGDICLEDLGLQDFDLAHEMIHQVDAIVNLAATTKFDERYDVALGINTLGALNVLNFAKRCAKVKILVHVSTAYVCGEKSGLIMETPYRMGETLNGTTGLDINYEKKLVQEKLDQLRVIGAAPETITETMKDLGLRRAKMYGWPNTYVFTKAMGEMMVGTKRENLSLVLLRPSIITSTFKEPFPGWTEGIRTIDSLAVGYGKGKLTCFLCDLDAVSDVMPADMVVNSILVSMAAQAGKQEEIIYHVGSSLRNPMKNSKFPELAYRYFSIKPWTNKEGKVVKVGAIEILSSMRSFHRYMTIRYLIALKGLELVNIILCKLFEKEFQYFNKKINFIFRLVDLYQPYLFFYGIFDDSNTEKLRKMVSKTGVENEMFYFDPKVLDWDDYFLNTHVIGLLKYVF

SEQ ID NO: 239 - DNA, 1482 bp, Arabidopsis thaliana, CER4 NM_119537
atgagcacagaaatggaggtcgttagtgttcttaagtaccttgacaacaaatccatattggtcgttggagctgctgggttcttagcaaatatctttgtggagaagatattaagggtggcaccaaacgtgaagaaactctatctccttctaagagcatcaaaaggaaaatctgctacccagaggtttaacgacgagattttgaagaaagatttgttcaaggtgctgaaggagaagtatggtcccaatctaaatcaacttacatcagagaaaatcactattgttgacggagacatttgccttgaggatttaggtcttcaagacttcgacttggctcatgagatgatccaccaagttgatgccattgttaatttagctgcaactactaagtttgatgaaagatacgatgtagctcttgggatcaacacattgggtgctctcaatgtcttgaactttgccaagagatgtgcaaaggttaagatccttgttcatgtatcaacagcttacgtgtgcggagaaaaatctggcttgataatggaaacaccgtaccgtatgggtgagacgttgaatggaaccaccggtttagacatcaactacgagaaaaaattggttcaggagaaacttgaccagctccgagtaatcggagccgctcctgaaaccatcacggaaaccatgaaggatctcggactcagacgggcaaagatgtacggatggccaaacacctatgtgttcaccaaagcaatgggggagatgatggtagggacaaaaagagaaaatctgtcacttgtgttgcttcgtccttcaattattaccagcacattcaaagaaccatttcctggttggactgagggcatcaggactattgatagtttagctgttggatatggcaaaggcaaactcacgtgcttcctctgtgatcttgatgctgtttctgatgtgatgccggcagatatggtagtaaattcgattcttgtatcaatggccgctcaagccggtaaacaagaagagattatttaccatgtgggttcttcacttagaaatccgatgaaaaattcaaagtttcctgaattagcgtatcggtatttctcaatcaaaccgtggaccaacaaagaagggaaggtcgttaaggtcggggccattgagatcctgagttctatgcgtagtttccatagatacatgaccatacgctacttgattgcattgaagggacttgaattggtaaacataatactttgcaagttgtttgagaaggaatttcagtatttcaataagaaaataaattttatattccggcttgttgatctctatcagccttacctctttttctatggaatatttgatgattcaaacacagaaaaattgcgaaaaatggtatcgaagacgggagtcgaaaacgagatgttttatttcgatccaaaggttctcgattgggacgactattttttgaacacacatgttattgggctgcttaagtatgtcttctaa

SEQ ID NO: 240 - protein, 527 aa, Arabidopsis thaliana, At3g56700  NC_003074
MATTNVLATSHAFKLNGVSYFSSFPRKPNHYMPRRRLSHTTRRVQTSCFYGETSFEAVTSLVTPKTETSRNSDGIGIVRFLEGKSYLVTGATGFLAKVLIEKLLRESLEIGKIFLLMRSKDQESANKRLYDEIISSDLFKLLKQMHGSSYEAFMKRKLIPVIGDIEEDNLGIKSEIANMISEEIDVIISCGGRTTFDDRYDSALSVNALGPAYVTGKREGTVLETPLCIGENITSDLNIKSELKLASEAVRKFRGREEIKKLKELGFERAQHYGWENSYTFTKAIGEAVIHSKRGNLPVVIIRPSIIESSYNEPFPGWIQGTRMADPIILAYAKGQISDFWADPQSLMDIIPVDMVANAAIAAMAKHGCGVPEFKVYNLTSSSHVNPMRAGKLIDLSHQHLCDFPLEETVIDLEHMKIHSSLEGFTSALSNTIIKQERVIDNEGGGLSTKGKRKLNYFVSLAKTYEPYTFFQARFDNTNTTSLIQEMSMEEKKTFGFDIKGIDWEHYIVNVHLPGLKKEFLSKKKTE

SEQ ID NO: 241 - DNA, 1584 bp, Arabidopsis thaliana, At3g56700  NC_003074
atggctaccacaaatgtcctcgccacgagccacgccttcaaattgaatggtgtcagctacttctcctcttttccccgcaaacctaaccactacatgcctcgtcgtcgtttatcacatactactcgtagagtccaaacttcgtgtttttatggtgagacgtcttttgaagctgtaacgtcgttagttacgcctaagacagaaacaagtcgtaacagtgacggaattggaatcgtccgtttcttagaagggaaaagctatcttgttactggtgcaacagggtttcttgccaaagtgttgattgagaaactgttgagggaaagtcttgaaattgggaagattttccttctgatgagatccaaggatcaagaatcagcaaacaagagactctacgatgagatcataagctcggatctgttcaagcttctgaagcaaatgcatgggagctcttacgaagctttcatgaagagaaagttgattccagtaattggagacattgaggaagacaatctagggatcaaatctgaaatagcaaacatgatcagtgaggagattgatgttattatcagttgtggtggtcgtacaacattcgacgacagatacgattctgccctaagtgtcaatgctcttggaccggcttacgtgactggtaagagagaggggacagtactagaaactcctctctgcattggagaaaacataacttctgacttgaacatcaaatccgagctgaaactagcttcagaagctgtaagaaagttccgtggcagagaagaaatcaagaaactcaaagaactcggttttgaaagagctcaacactatgggtgggaaaatagttacacattcacaaaagccataggtgaggctgtaattcacagcaagcgaggaaacttgcctgtagtgatcataaggcctagtattatcgaaagctcttacaatgagcctttccctggctggatccaagggacaagaatggctgatccaatcatcttggcttatgccaaaggccagatttctgacttctgggcagatcctcaatctttgatggacattatacctgttgacatggttgcaaacgcagcaatagcagccatggcaaagcatggttgtggtgtcccagagttcaaagtttacaatttaacttcttcatctcatgtgaaccccatgcgtgctggcaaattgatagacctctctcatcaacatctgtgtgactttccattggaagaaacagtgatagacttagagcacatgaaaatccacagttccttagagggtttcacttctgctttatcgaacacaataataaaacaggaaagagtgattgataatgaaggaggaggattgagcacgaagggaaagaggaagctaaactattttgtgtccttggcaaaaacgtatgagccttacacattctttcaagctcggtttgacaacaccaatacaacaagtctgatacaggagatgtcaatggaagagaaaaaaacgtttgggttcgatatcaaaggcattgactgggagcattacattgtcaacgttcatcttccaggtctcaaaaaggaatttctttctaagaagaagactgagtaa

SEQ ID NO: 242 - protein, 491 aa, Arabidopsis thalian, At5g22500  NC_003076
MESNCVQFLGNKTILITGAPGFLAKVLVEKILRLQPNVKKIYLLLRAPDEKSAMQRLRSEVMEIDLFKVLRNNLGEDNLNALMREKIVPVPGDISIDNLGLKDTDLIQRMWSEIDIIINIAATTNFDERYDIGLGINTFGALNVLNFAKKCVKGQLLLHVSTAYISGEQPGLLLEKPFKMGETLSGDRELDINIEHDLMKQKLKELQDCSDEEISQTMKDFGMARAKLHGWPNTYVFTKAMGEMLMGKYRENLPLVIIRPTMITSTIAEPFPGWIEGLKTLDSVIVAYGKGRLKCFLADSNSVFDLIPADMVVNAMVAAATAHSGDTGIQAIYHVGSSCKNPVTFGQLHDFTARYFAKRPLIGRNGSPIIVVKGTILSTMAQFSLYMTLRYKLPLQILRLINIVYPWSHGDNYSDLSRKIKLAMRLVELYQPYLLFKGIFDDLNTERLRMKRKENIKELDGSFEFDPKSIDWDNYITNTHIPGLITHVLKQ

SEQ ID NO: 243 - DNA, 1476 bp, Arabidopsis thalian, At5g22500  NC_003076
atggaatccaattgtgttcaatttctcggtaacaagaccattctcatcacaggagctcctggttttcttgccaaggttttggtagagaaaatactaaggttgcaaccaaatgtgaagaagatataccttctgttgagagctcccgacgaaaaatcagccatgcaacgcctacgtagtgaggttatggagatcgacctttttaaagtgttgaggaacaatctaggagaagacaatttgaatgccttgatgcgggaaaaaattgtgccggttccaggtgatatatcgatcgataatttgggattgaaagacactgatctcatacaacgtatgtggagtgagattgatatcataatcaacatagcagccacaacaaatttcgatgaaagatatgatattggtcttggcatcaacacatttggagccctgaatgttctcaacttcgccaaaaagtgtgttaaaggacaattgcttctccatgtctcaaccgcgtatataagcggtgaacaacctggattgttactagagaaaccattcaagatgggggagactctcagcggggatcgggaactagacatcaatatagaacatgatctaatgaaacaaaaattgaaagagcttcaagattgttctgatgaagaaatctcgcaaacaatgaaagattttggaatggcaagggcaaagcttcatggatggccaaatacctatgtattcaccaaagcaatgggagagatgctaatgggaaaatacagagaaaatttgccacttgttatcatacgtccaacaatgattacgagtactattgccgaaccattccccggttggattgaagggttgaaaacattagacagtgtgattgttgcttatggtaaaggaaggcttaaatgttttcttgcggattcaaactcagtctttgaccttataccggcagacatggtagtaaatgcgatggttgcagccgcgacagctcattcgggagacaccgggattcaggcaatatatcatgttggttcgtcttgtaagaatccagtcacgtttggacaacttcacgatttcacggctcgttacttcgctaaacgtcctttgattggtcggaatggctcgccaatcatagtggtcaaaggaaccattctgtccactatggctcaattcagcctctacatgacccttcgttacaagcttcctctacagatacttcgattgatcaatatagtttatccatggagtcacggagataactacagtgacctaagccgcaaaatcaagctagctatgcgtttagttgagctttaccagccttacttactcttcaagggcatatttgatgatttaaataccgaaagactgcgaatgaaaagaaaggagaatatcaaagagttagatggatcgttcgagttcgatcccaagtccattgattgggacaattatatcacaaacacccacattcctggcctcatcacccatgtgcttaaacaataa

SEQ ID NO: 244 - protein, 507 aa, Triticum aestivum (Wheat bread) AJ459250
MVDTLSEENIIGYFKNKSILITGSTGFLGKILVEKILRVQPDVKKIYLPVRAVDAAAAKHRVETEVVGKELFGLLREKHGGRFQSFIWEKIVPLAGDVMREDFGVDSETLRELRVTQELDVIVNGAATTNFYERYDVALDVNVMGVKHMCNFAKKCPNLKVLLHVSTAYVAGEKQGLVQERPFKNGETLLEGTRLDIDTELKLAKDLKKQLEADVDSSPKAERKAMKDLGLTRARHFRWPNTYVFTKSMGEMVLSQLQCDVPVVIVRPSIITSVQNDPLPGWIEGTRTIDTIVIGYAKQNLTYFLADLNLTMDVMPGDMVVNAMMAAIVAHSSSSLEKTKSHPKQHAPAVYHVSSSLRNPAPYNVLHEAGFRYFTEHPRVGPDGRTVRTHKMTFLSSMASFHLFMMLRYRLLLELLHLLSILCCGLFGLDTLYHDQARKYRFVMHLVDLYGPFALFKGCFDDVNLNKLRLAMTSNHGSLFNFDPKTIDWDEYFYRVHIPGVIKYMLK

SEQ ID NO: 245 - DNA, 1524 bp, Triticum aestivum (Wheat bread) AJ459250
atggttgacacactgagtgaagagaacatcattggatacttcaagaacaagagcatcctcatcactggatcaacaggctttcttggaaagatactggtggagaagatactgagagttcaacctgatgtgaagaagatttacctcccggtgcgagcggtggatgccgcggcggcaaagcatcgggtggagactgaggtggtagggaaggagttgttcgggcttctgagggagaagcacgggggcaggtttcaatctttcatctgggaaaagatcgtcccattggccggagacgtgatgcgcgaggacttcggcgtggacagcgagaccctgagggagctccgggtgacccaggagctcgatgtcatcgttaatggcgccgccaccaccaacttctacgaaaggtatgatgtggctctagacgtgaacgtgatgggagtgaagcacatgtgcaacttcgccaagaagtgccccaatctcaaggtgctcctccatgtctccacggcttacgtggcgggtgagaagcaagggctggtgcaagagagaccattcaagaatggcgagacgctgctggaggggacccgcctcgacatcgacactgagctgaaactggccaaggacctgaaaaagcagcttgaggccgacgttgattcgtcgcccaaggccgaaaggaaggccatgaaggatcttggccttaccagggcccggcacttcaggtggccaaacacatacgtgttcaccaagtcgatgggggagatggtgctaagccagttgcagtgtgatgtccccgttgtcatcgtccgtcccagcatcatcacaagtgtccagaacgacccactgcccggatggatcgaaggcaccaggacgatcgacacgatcgtgatcggctatgcgaagcagaacctgacatacttcttggccgacctcaacctcaccatggatgtgatgccgggcgacatggtggtgaatgcgatgatggcggcaatagtggcacacagctcgtcctcattggagaagacaaagtcacatcccaagcaacatgcaccggcggtgtaccacgtgagctcgtcgctgcgtaatccggcaccatacaatgtgcttcatgaggctgggtttcggtacttcacggagcaccctcgcgtgggccctgacggtcgcaccgtgcgtacccataagatgacattcctcagcagcatggcttccttccacctatttatgatgctcagataccgcctcctcttagagctcctccacctgctctccatcctctgctgcggcctcttcggcctcgacaccctctaccacgaccaagcacgcaagtacaggttcgtgatgcacctggtggatctgtacgggccctttgcgctgttcaaggggtgcttcgatgacgtcaacctaaacaagctcaggctcgccatgaccagcaaccatggtagcctcttcaatttcgacccgaagaccattgattgggacgagtacttctacagggtccacatccccggggtcataaagtacatgctcaagtga

We claim:

1. A cell culture comprising modified Cyanobacteria having a genetic modification including at least one of:
    addition of an endogenous NbIA gene, addition of an exogenous NbIA gene, or addition of a promoter that regulates NbIA gene expression, wherein the genetic modification results in changes that, as compared to corresponding wild-type Cyanobacteria, include:
        an increased level of NbIA polypeptide or a biologically active fragment of NbIA polypeptide that includes a conserved domain,
        an enhanced level of photosynthetic activity, and
        a reduced amount of a light harvesting protein (LHP).

2. The cell culture of claim 1, wherein the modified cyanobacteria grow, divide or both at an increased rate as compared to the corresponding wild-type Cyanobacteria.

3. The cell culture of claim 1, wherein the modified Cyanobacteria have at least one of:
    a reduced amount of phycobilisomes as compared to the corresponding wild-type Cyanobacteria; or
    an increased proteolytic degradation of phycobilisomes as compared to the corresponding wild-type Cyanobacteria.

4. The cell culture of claim 1, wherein the modified Cyanobacteria have at least one of:
    an enhanced expression of the endogenous NbIA gene as compared to the corresponding wild-type Cyanobacteria;
    a reduced level of a photosystem II-associated light harvesting protein as compared to the corresponding wild-type Cyanobacteria; or
    a reduced amount of phycobiliproteins as compared to the corresponding wild-type Cyanobacteria.

5. The cell culture of claim 1, wherein the genetic modification comprises replacement of a wild-type promoter for the endogenous NbIA gene with a different promoter.

6. The cell culture of claim 1, wherein the photosynthetic activity is measured based on at least one of a growth rate, a level of oxygen evolution, or a biomass accumulation rate.

7. The cell culture of claim 1, wherein a growth rate of the modified Cyanobacteria is at least about 120% of a growth rate of the corresponding wild-type Cyanobacteria.

8. A method for generating modified Cyanobacteria, comprising:

modifying a Cyanobacteria by adding an endogenous NbIA gene, adding an exogenous NbIA gene, or adding a promoter that regulates NbIA gene expression thereby:
  increasing a level of a NbIA polypeptide or a biologically active fragment of the NbIA polypeptide that includes a conserved domain, as compared to a corresponding wild-type Cyanobacteria,
  enhancing a level of photosynthetic activity as compared to the corresponding wild-type Cyanobacteria, and
  reducing an amount of a light harvesting protein (LHP) as compared to the corresponding wild-type Cyanobacteria.

9. The method of claim 8, wherein the modified cyanobacteria grow, divide, or both at an increased rate as compared to the corresponding wild-type Cyanobacteria.

10. The method of claim 8, wherein the modified Cyanobacteria have at least one of:
  a reduced amount of phycobilisomes as compared to the corresponding wild-type Cyanobacteria; or
  an increased proteolytic degradation of phycobilisomes as compared to the corresponding wild-type Cyanobacteria.

11. The method of claim 8, wherein the modified Cyanobacteria have at least one of:
  an enhanced expression of the endogenous NbIA gene as compared to the corresponding wild-type Cyanobacteria;
  a reduced level of a photosystem II-associated light harvesting protein as compared to the corresponding wild-type Cyanobacteria; or
  a reduced amount of phycobiliproteins as compared to the corresponding wild-type Cyanobacteria.

12. The method of claim 8, wherein adding the promoter comprises replacing a wild-type promoter for the endogenous NbIA gene with a different promoter.

13. The method of claim 8, wherein the photosynthetic activity is measured based on at least one of a growth rate, a level of oxygen evolution, or a biomass accumulation rate.

14. A modified Cyanobacterium comprising a genetic modification including at least one of:
  addition of an endogenous NbIA gene, addition of an exogenous NbIA gene, or addition of a promoter that regulates NbIA gene expression, wherein the genetic modification results in changes that, as compared to a corresponding wild-type Cyanobacterium, include:
    increased levels of NbIA polypeptide or a biologically active fragment of NbIA polypeptide that includes a conserved domain domain,
    an enhanced level of photosynthetic activity, and
    a reduced amount of a light harvesting protein (LHP).

15. The modified Cyanobacterium of claim 14, wherein the modified Cyanobacterium grow, divide, or both at an increased rate as compared to the corresponding wild-type Cyanobacterium.

16. The modified Cyanobacterium of claim 14, wherein the modified Cyanobacterium has at least one of:
  a reduced amount of phycobilisomes as compared to the corresponding wild-type Cyanobacterium; or
  an increased proteolytic degradation of phycobilisomes as compared to the corresponding wild-type Cyanobacterium.

17. The modified Cyanobacterium of claim 14, wherein the modified Cyanobacterium has at least one of:
  an enhanced expression of the endogenous NbIA gene as compared to the corresponding wild-type Cyanobacteria;
  a reduced level of a photosystem II-associated light harvesting protein as compared to the corresponding wild-type Cyanobacteria; or
  a reduced amount of phycobiliproteins as compared to the corresponding wild-type Cyanobacteria.

18. The modified Cyanobacterium of claim 14, wherein the addition of the promoter that regulates NbIA gene expression comprises replacement of a wild-type promoter for the endogenous NbIA gene with a different promoter.

19. The modified Cyanobacterium of claim 14, wherein the photosynthetic activity is measured based on at least one of a growth rate, a level of oxygen evolution, or a biomass accumulation rate.

20. The cell culture of claim 5, wherein the different promoter comprises an inducible promoter or a constitutive promoter.

21. The method of claim 12, wherein the different promoter comprises an inducible promoter or a constitutive promoter.

22. The modified Cyanobacterium of claim 14, wherein a growth rate of the modified Cyanobacterium is at least about 120% of a growth rate of the corresponding wild-type Cyanobacterium.

23. The modified Cyanobacterium of claim 18, wherein the different promoter comprises an inducible promoter or a constitutive promoter.

* * * * *